US012805528B2

(12) United States Patent
Rezaei et al.

(10) Patent No.: US 12,805,528 B2
(45) Date of Patent: Nov. 24, 2026

(54) BIOFILM COMPOSITIONS WITH IMPROVED STABILITY FOR NITROGEN FIXING MICROBIAL PRODUCTS

(71) Applicant: Pivot Bio, Inc., Minnetonka, MN (US)

(72) Inventors: Farzaneh Rezaei, Berkeley, CA (US); Shayin Gottlieb, Martinez, CA (US)

(73) Assignee: Pivot Bio, Inc., Minnetonka, MN (US)

( * ) Notice: Subject to any disclaimer, the term of this patent is extended or adjusted under 35 U.S.C. 154(b) by 667 days.

(21) Appl. No.: 17/287,377

(22) PCT Filed: Nov. 1, 2019

(86) PCT No.: PCT/US2019/059450
§ 371 (c)(1),
(2) Date: Apr. 21, 2021

(87) PCT Pub. No.: WO2020/092940
PCT Pub. Date: May 7, 2020

(65) Prior Publication Data
US 2021/0315212 A1 Oct. 14, 2021

Related U.S. Application Data

(60) Provisional application No. 62/754,468, filed on Nov. 1, 2018.

(51) Int. Cl.

| | |
|---|---|
| ***A01N 63/20*** | (2020.01) |
| ***C12N 1/04*** | (2006.01) |
| ***C12N 1/20*** | (2026.01) |
| *C12R 1/22* | (2006.01) |

(52) U.S. Cl.
CPC ............... *A01N 63/20* (2020.01); *C12N 1/04* (2013.01); *C12N 1/20* (2013.01); *C12R 2001/22* (2021.05)

(58) Field of Classification Search
CPC . A01N 63/20; C12N 1/04; C12N 1/20; C12N 1/205; C12R 2001/22
See application file for complete search history.

(56) References Cited

U.S. PATENT DOCUMENTS

| | | | |
|---|---|---|---|
| 1,520,545 | A | 12/1924 | Murphy |
| 4,782,022 | A | 11/1988 | Puhler et al. |
| 4,832,728 | A | 5/1989 | Allan et al. |
| 4,970,147 | A | 11/1990 | Huala et al. |
| 5,071,743 | A | 12/1991 | Slilaty et al. |
| 5,113,619 | A | 5/1992 | Leps et al. |
| 5,116,506 | A | 5/1992 | Williamson et al. |
| 5,229,291 | A | 7/1993 | Nielsen et al. |
| 5,300,127 | A | 4/1994 | Williams |
| 5,354,670 | A | 10/1994 | Nickoloff et al. |
| 5,427,785 | A | 6/1995 | Ronson et al. |
| 5,780,270 | A | 7/1998 | Lesley |
| 5,789,166 | A | 8/1998 | Bauer et al. |
| 5,916,029 | A | 6/1999 | Smith et al. |
| 6,033,861 | A | 3/2000 | Schafer et al. |
| 6,114,148 | A | 9/2000 | Seed et al. |
| 6,391,548 | B1 | 5/2002 | Bauer et al. |
| 6,484,879 | B2 | 11/2002 | Desmarais et al. |
| 6,548,289 | B1 | 4/2003 | Beynon et al. |
| 6,596,509 | B1 | 7/2003 | Bauer et al. |
| 6,673,610 | B2 | 1/2004 | Miyawaki et al. |
| 6,713,285 | B2 | 3/2004 | Bauer et al. |
| 6,773,900 | B2 | 8/2004 | Short et al. |
| 6,821,590 | B2 | 11/2004 | Verrall et al. |
| 6,841,358 | B1 | 1/2005 | Locht et al. |
| 7,005,168 | B2 | 2/2006 | Verrall et al. |
| 7,084,331 | B2 | 8/2006 | Isawa et al. |
| 7,132,265 | B2 | 11/2006 | Bauer et al. |
| 7,357,891 | B2 | 4/2008 | Yang et al. |
| 7,470,427 | B2 | 12/2008 | Cocking |
| 7,485,451 | B2 | 2/2009 | Vandergheyst et al. |
| 7,642,226 | B2 | 1/2010 | Verrall et al. |
| 7,803,872 | B2 | 9/2010 | Verrall et al. |
| 7,824,588 | B2 | 11/2010 | Yang et al. |
| 7,897,080 | B2 | 3/2011 | Yang et al. |

(Continued)

FOREIGN PATENT DOCUMENTS

| | | | |
|---|---|---|---|
| AU | 2018314720 | A1 | 5/2019 |
| CA | 2 051 071 | A1 | 3/1993 |

(Continued)

OTHER PUBLICATIONS

Meriam-Webster, “Prevent”, Merriam Webster Dictionary, available online at https://www.merriam-webster.com/dictionary/preventing?utm_campaign=sd&utm_medium=serp&utm_source=jsonld, 6 pages, (accesed on Oct. 15, 2024) at p. 1. (Year: 2024).*

Balasundararajan et al., Journal of Basic Microbiology, 2019, vol. 59, pp. 1031-1039. (Year: 2019).*

Meriam-Webster, “Prevent”, Merriam Webster Dictionary, available online at https://www.merriam-webster.com/dictionary/preventing?utm_campaign=sd&utm_medium=serp&utm_source=jsonld, 6 p. (accesed on Oct. 15, 2024) at p. 1 . . . (Year: 2024).*

Ikuma et al., 2013, The Extracellular Bastions of Bacteria—A Biofilm Way of Life, Nature Education Knowledge 4(2):2 , retrieved from https://www.nature.com/scitable/knowledge/library/the-extracellular-bastions-of-bacteria-nbsp-a-100450088/ on Oct. 16, 2024 . . . (Year: 2013).*

(Continued)

*Primary Examiner* — Lianko G Garyu
*Assistant Examiner* — Claudia Espinosa
(74) *Attorney, Agent, or Firm* — COOLEY LLP

(57) ABSTRACT

The present disclosure provides the integration of exogenous microbial biofilms to confer increased stability and viability for an extended shelf life of desired microbes (e.g., bacteria), as compared to those microbes in the absence of the exogenous microbial biofilms. The microbes include transgenic microbes, non-transgenic microbes, and non-intergeneric remodeled microbes. The utilization of the taught microbial products will enable a significant expansion of the typical shelf life of microbial compositions. The microbes comprising exogenous biofilms taught herein are able to be combined with other agriculturally beneficial compositions.

20 Claims, 19 Drawing Sheets

Specification includes a Sequence Listing.

(56) References Cited

U.S. PATENT DOCUMENTS

| | | | |
|---|---|---|---|
| 8,029,593 | B2 | 10/2011 | Amy |
| 8,076,142 | B2 | 12/2011 | Huang et al. |
| 8,137,665 | B2 | 3/2012 | Cocking |
| 8,268,584 | B1 | 9/2012 | Harwood et al. |
| 8,268,914 | B2 | 9/2012 | Verrall et al. |
| 8,377,671 | B2 | 2/2013 | Cournac et al. |
| 8,481,026 | B1 | 7/2013 | Woodruff et al. |
| 8,617,589 | B2 | 12/2013 | Fuisz et al. |
| 8,728,449 | B2 | 5/2014 | Verrall et al. |
| 8,795,965 | B2 | 8/2014 | Zhang |
| 9,073,294 | B2 | 7/2015 | Kumar et al. |
| 9,150,782 | B2 | 10/2015 | Lee et al. |
| 9,150,851 | B2 | 10/2015 | Wigley et al. |
| 9,321,697 | B2 | 4/2016 | Das et al. |
| 9,394,092 | B2 | 7/2016 | Lee et al. |
| 9,487,451 | B2 | 11/2016 | Doty et al. |
| 9,512,431 | B2 | 12/2016 | Mirsky et al. |
| 9,546,352 | B2 | 1/2017 | Mazeaud et al. |
| 9,657,298 | B2 | 5/2017 | Soto, Sr. et al. |
| 9,670,437 | B2 | 6/2017 | Kumar et al. |
| 9,670,440 | B2 | 6/2017 | Bullock et al. |
| 9,700,519 | B2 | 7/2017 | Zicari et al. |
| 9,796,833 | B2 | 10/2017 | Verrall et al. |
| 9,828,154 | B2 | 11/2017 | Edwards |
| 9,834,354 | B2 | 12/2017 | Kumar et al. |
| 9,873,558 | B2 | 1/2018 | Edwards |
| 9,908,675 | B2 | 3/2018 | Lee et al. |
| 9,957,509 | B2 | 5/2018 | Mirsky et al. |
| 9,975,817 | B2 | 5/2018 | Temme et al. |
| 10,087,401 | B2 | 10/2018 | Lee et al. |
| 10,183,794 | B2 | 1/2019 | Souter et al. |
| 10,202,227 | B2 | 2/2019 | Nii et al. |
| 10,208,422 | B2 | 2/2019 | Edwards et al. |
| 10,384,983 | B2 | 8/2019 | Temme et al. |
| 10,428,297 | B2 | 10/2019 | Souter et al. |
| 10,443,024 | B2 | 10/2019 | Souter et al. |
| 10,513,588 | B2 | 12/2019 | Friedrich et al. |
| 10,526,479 | B2 | 1/2020 | Friedrich et al. |
| 10,556,839 | B2 | 2/2020 | Temme et al. |
| 10,562,701 | B2 | 2/2020 | Lee et al. |
| 10,604,318 | B2 | 3/2020 | Kumar et al. |
| 10,611,555 | B2 | 4/2020 | Edwards |
| 10,662,432 | B2 | 5/2020 | Mirsky et al. |
| 10,696,460 | B2 | 6/2020 | Lee et al. |
| 10,808,210 | B2 | 10/2020 | Lee et al. |
| 10,815,346 | B2 | 10/2020 | Nii et al. |
| 10,829,621 | B2 | 11/2020 | Lee et al. |
| 10,844,183 | B2 | 11/2020 | Friedrich et al. |
| 10,899,518 | B2 | 1/2021 | Keuleers et al. |
| 10,907,117 | B2 | 2/2021 | Souter et al. |
| 10,913,832 | B2 | 2/2021 | Friedrich et al. |
| 10,919,814 | B2 | 2/2021 | Temme et al. |
| 10,934,226 | B2 | 3/2021 | Temme et al. |
| 10,968,446 | B2 | 4/2021 | Zhao et al. |
| 11,028,352 | B2 | 6/2021 | Simonsen et al. |
| 11,104,497 | B2 | 8/2021 | Lee et al. |
| 11,168,289 | B2 | 11/2021 | Friedrich et al. |
| 11,193,092 | B2 | 12/2021 | Goetz et al. |
| 11,352,468 | B2 | 6/2022 | Lee et al. |
| 11,407,866 | B2 | 8/2022 | Childers et al. |
| 11,453,754 | B2 | 9/2022 | Childers et al. |
| 11,459,433 | B2 | 10/2022 | Nii et al. |
| 11,473,039 | B2 | 10/2022 | Souter et al. |
| 11,473,040 | B2 | 10/2022 | Courchay et al. |
| 11,479,516 | B2 | 10/2022 | Voigt et al. |
| 11,492,190 | B2 | 11/2022 | Nakano |
| 11,565,979 | B2 | 1/2023 | Temme et al. |
| 11,678,667 | B2 | 6/2023 | Reisinger et al. |
| 11,678,668 | B2 | 6/2023 | Reisinger et al. |
| 11,739,032 | B2 | 8/2023 | Temme et al. |
| 11,946,162 | B2 | 4/2024 | Zhao et al. |
| 11,963,530 | B2 | 4/2024 | Reisinger et al. |
| 11,993,778 | B2 | 5/2024 | Tamsir et al. |
| 12,209,245 | B2 | 1/2025 | Mirsky et al. |
| 12,281,299 | B2 | 4/2025 | Voigt et al. |
| 12,281,980 | B2 | 4/2025 | Wood et al. |
| 12,290,074 | B2 | 5/2025 | Reisinger et al. |
| 12,391,624 | B2 | 8/2025 | Tamsir et al. |
| 12,421,519 | B2 | 9/2025 | Higgins et al. |
| 12,471,599 | B2 | 11/2025 | Reisinger et al. |
| 12,478,068 | B2 | 11/2025 | Rezaei et al. |
| 12,497,342 | B2 | 12/2025 | Temme et al. |
| 12,610,956 | B2 | 4/2026 | Reisinger et al. |
| 12,612,639 | B2 | 4/2026 | Bloch et al. |
| 12,612,669 | B2 | 4/2026 | Ryu et al. |
| 2001/0033883 | A1 | 10/2001 | Boody |
| 2004/0235663 | A1 | 11/2004 | Cocking |
| 2004/0241847 | A1 | 12/2004 | Okuyama et al. |
| 2005/0081262 | A1 | 4/2005 | Cook et al. |
| 2005/0266541 | A1 | 12/2005 | Dillon |
| 2006/0096918 | A1 | 5/2006 | Semmens |
| 2006/0127988 | A1 | 6/2006 | Wood et al. |
| 2006/0243011 | A1 | 11/2006 | Someus |
| 2007/0068072 | A1 | 3/2007 | Xavier et al. |
| 2008/0311632 | A1 | 12/2008 | Figge et al. |
| 2009/0105076 | A1 | 4/2009 | Stewart et al. |
| 2009/0137390 | A1 | 5/2009 | Tripplett |
| 2009/0152195 | A1 | 6/2009 | Rodgers et al. |
| 2009/0162477 | A1 | 6/2009 | Nadel et al. |
| 2009/0258404 | A1 | 10/2009 | Mikkelsen et al. |
| 2009/0308121 | A1 | 12/2009 | Reddy et al. |
| 2010/0028870 | A1 | 2/2010 | Welch et al. |
| 2010/0267147 | A1 | 10/2010 | Qiao |
| 2011/0104690 | A1 | 5/2011 | Yu et al. |
| 2012/0015806 | A1 | 1/2012 | Paikray et al. |
| 2012/0107889 | A1 | 5/2012 | Doty et al. |
| 2012/0192605 | A1 | 8/2012 | Mcspadden Gardener et al. |
| 2012/0266332 | A1 | 10/2012 | Kuykendall |
| 2012/0284813 | A1 | 11/2012 | Olivier et al. |
| 2013/0126428 | A1 | 5/2013 | Jones et al. |
| 2014/0011261 | A1 | 1/2014 | Wang et al. |
| 2014/0155283 | A1 | 6/2014 | Venkateswaran et al. |
| 2014/0230504 | A1 | 8/2014 | Finlayson et al. |
| 2014/0273226 | A1 | 9/2014 | Wu |
| 2014/0301990 | A1 | 10/2014 | Gregory et al. |
| 2014/0329326 | A1 | 11/2014 | Mirsky et al. |
| 2014/0336050 | A1 | 11/2014 | Soto, Sr. et al. |
| 2015/0080261 | A1 | 3/2015 | Wigley et al. |
| 2015/0101373 | A1 | 4/2015 | Munusamy et al. |
| 2015/0128670 | A1 | 5/2015 | Das |
| 2015/0237807 | A1 | 8/2015 | Valiquette |
| 2015/0239789 | A1 | 8/2015 | Kang et al. |
| 2015/0315570 | A1 | 11/2015 | Zhao et al. |
| 2016/0174570 | A1 | 6/2016 | Vujanovic et al. |
| 2016/0264929 | A1 | 9/2016 | Barney et al. |
| 2016/0292355 | A1 | 10/2016 | Lou et al. |
| 2016/0295868 | A1 | 10/2016 | Jones et al. |
| 2017/0119690 | A1 | 5/2017 | Hansen et al. |
| 2017/0135378 | A1 | 5/2017 | Tse et al. |
| 2017/0143006 | A1 | 5/2017 | Awati et al. |
| 2017/0152519 | A1 | 6/2017 | Mirsky et al. |
| 2017/0367349 | A1 | 12/2017 | Gruver et al. |
| 2018/0002243 | A1 | 1/2018 | Temme et al. |
| 2018/0020671 | A1 | 1/2018 | Wigley et al. |
| 2018/0065896 | A1 | 3/2018 | Van Iersel et al. |
| 2018/0073028 | A1 | 3/2018 | Mirsky et al. |
| 2018/0078586 | A1 | 3/2018 | Jones et al. |
| 2018/0153174 | A1 | 6/2018 | Riley et al. |
| 2018/0290942 | A1 | 10/2018 | Voigt et al. |
| 2019/0039964 | A1 | 2/2019 | Temme et al. |
| 2019/0144352 | A1 | 5/2019 | Temme et al. |
| 2019/0307131 | A1 | 10/2019 | Yoon et al. |
| 2019/0339964 | A1 | 11/2019 | Young et al. |
| 2019/0348154 | A1 | 11/2019 | Fröse et al. |
| 2020/0008431 | A1 | 1/2020 | Mitter et al. |
| 2020/0085065 | A1 | 3/2020 | Kellar et al. |
| 2020/0115715 | A1 | 4/2020 | Mirsky et al. |
| 2020/0163343 | A1 | 5/2020 | Verstraete et al. |
| 2020/0299637 | A1 | 9/2020 | Voigt et al. |
| 2020/0308594 | A1 | 10/2020 | Tamsir et al. |
| 2020/0331820 | A1 | 10/2020 | Tamsir et al. |
| 2021/0009483 | A1 | 1/2021 | Temme et al. |
| 2021/0163374 | A1 | 6/2021 | Bloch et al. |
| 2021/0214282 | A1 | 7/2021 | Temme et al. |

(56) References Cited

U.S. PATENT DOCUMENTS

| | | | |
|---|---|---|---|
| 2021/0284995 | A1 | 9/2021 | Zhao et al. |
| 2021/0345618 | A1 | 11/2021 | Bloch et al. |
| 2022/0017911 | A1 | 1/2022 | Temme et al. |
| 2022/0079163 | A1 | 3/2022 | Reisinger et al. |
| 2022/0090095 | A1 | 3/2022 | Higgins et al. |
| 2022/0106238 | A1 | 4/2022 | Rezaei et al. |
| 2022/0127627 | A1 | 4/2022 | Bloch et al. |
| 2022/0162544 | A1 | 5/2022 | Voigt et al. |
| 2022/0211048 | A1 | 7/2022 | Temme et al. |
| 2022/0282340 | A1 | 9/2022 | Ryu et al. |
| 2022/0396530 | A1 | 12/2022 | Tamsir et al. |
| 2022/0411344 | A1 | 12/2022 | Voigt et al. |
| 2023/0019267 | A1 | 1/2023 | Hapes et al. |
| 2023/0033451 | A1 | 2/2023 | Reisinger et al. |
| 2023/0062568 | A1 | 3/2023 | Temme et al. |
| 2023/0148607 | A1 | 5/2023 | Rezaei et al. |
| 2023/0175959 | A1 | 6/2023 | Wood et al. |
| 2023/0257317 | A1 | 8/2023 | Temme et al. |
| 2023/0276807 | A1 | 9/2023 | Reisinger et al. |
| 2023/0295559 | A1 | 9/2023 | Ozaydin Eskiyenenturk et al. |
| 2024/0010576 | A1 | 1/2024 | Temme et al. |
| 2025/0027228 | A1 | 1/2025 | Zhao et al. |
| 2025/0075222 | A1 | 3/2025 | Bloch et al. |
| 2025/0115529 | A1 | 4/2025 | Tamsir et al. |
| 2025/0137985 | A1 | 5/2025 | Nevins et al. |
| 2025/0145544 | A1 | 5/2025 | Strobel et al. |
| 2025/0185667 | A1 | 6/2025 | Reisinger et al. |
| 2025/0207141 | A1 | 6/2025 | Mirsky et al. |
| 2025/0228153 | A1 | 7/2025 | O'Bryan et al. |
| 2025/0257316 | A1 | 8/2025 | Voigt et al. |
| 2025/0346911 | A1 | 11/2025 | Higgins et al. |
| 2025/0366419 | A1 | 12/2025 | Bloch et al. |
| 2025/0369878 | A1 | 12/2025 | Wood et al. |
| 2025/0376424 | A1 | 12/2025 | Tamsir et al. |
| 2026/0015620 | A1 | 1/2026 | Mirsky et al. |
| 2026/0041099 | A1 | 2/2026 | Reisinger et al. |
| 2026/0041100 | A1 | 2/2026 | Rezaei et al. |
| 2026/0107948 | A1 | 4/2026 | Reisinger et al. |

FOREIGN PATENT DOCUMENTS

| | | | | |
|---|---|---|---|---|
| CN | 102031231 | A | 4/2011 | |
| CN | 102093995 | A | 6/2011 | |
| CN | 102595938 | A | 7/2012 | |
| CN | 104244985 | A | 12/2014 | |
| CN | 104364372 | A | 2/2015 | |
| CN | 105039300 | A | 11/2015 | |
| CN | 107494518 | A | 12/2017 | |
| CN | 113662009 | A | 11/2021 | |
| EP | 1072258 | A1 | 1/2001 | |
| EP | 1375637 | A1 | 1/2004 | |
| EP | 1394065 | A1 | 3/2004 | |
| EP | 2 186 890 | A1 | 5/2010 | |
| EP | 2978300 | B1 | 12/2020 | |
| EP | 3131866 | B1 | 7/2022 | |
| FR | 2494297 | | 5/1982 | |
| JP | 2018528760 | A | 10/2018 | |
| RU | 2567668 | C2 | 11/2015 | |
| WO | WO-87/04182 | A1 | 7/1987 | |
| WO | WO-93/05154 | A1 | 3/1993 | |
| WO | WO-98/01088 | A1 | 1/1998 | |
| WO | WO-99/09834 | A2 | 3/1999 | |
| WO | WO-00/57183 | A1 | 9/2000 | |
| WO | WO-01/07567 | A1 | 2/2001 | |
| WO | WO-03089640 | A2 | 10/2003 | |
| WO | WO-2006/005100 | A1 | 1/2006 | |
| WO | WO-2009/060012 | A2 | 5/2009 | |
| WO | WO-2009/091557 | A1 | 7/2009 | |
| WO | WO-2010088112 | A1 | 8/2010 | |
| WO | WO-2011004375 | A1 | 1/2011 | |
| WO | WO-2011/099019 | A1 | 8/2011 | |
| WO | WO-2011/099024 | A1 | 8/2011 | |
| WO | WO-2011/154960 | A1 | 12/2011 | |
| WO | WO-2012/174271 | A2 | 12/2012 | |
| WO | WO-2013/076687 | A2 | 5/2013 | |
| WO | WO-2013/132518 | A1 | 9/2013 | |
| WO | WO-2013142792 | A1 | 9/2013 | |
| WO | WO-2014/042517 | A2 | 3/2014 | |
| WO | WO-2014/071182 | A1 | 5/2014 | |
| WO | WO-2014/201044 | A2 | 12/2014 | |
| WO | WO-2014202412 | A1 | 12/2014 | |
| WO | WO-2016/016629 | A1 | 2/2016 | |
| WO | WO-2016/016630 | A1 | 2/2016 | |
| WO | WO-2016/100727 | A1 | 6/2016 | |
| WO | WO-2016/146955 | A1 | 9/2016 | |
| WO | WO-2016/178580 | A2 | 11/2016 | |
| WO | WO-2016/179046 | A1 | 11/2016 | |
| WO | WO-2016/181228 | A2 | 11/2016 | |
| WO | WO-2016/191828 | A1 | 12/2016 | |
| WO | WO-2017/011602 | A1 | 1/2017 | |
| WO | WO-2017/042833 | A1 | 3/2017 | |
| WO | WO-2017/062412 | A1 | 4/2017 | |
| WO | WO-2017/069717 | A1 | 4/2017 | |
| WO | WO-2017/203440 | A1 | 11/2017 | |
| WO | WO-2017208237 | A1 * | 12/2017 | ........... A23L 33/135 |
| WO | WO-2018045051 | A1 | 3/2018 | |
| WO | WO-2018132774 | A1 * | 7/2018 | ............... A01C 1/06 |
| WO | WO-2019/032926 | A1 | 2/2019 | |
| WO | WO-2019/084059 | A2 | 5/2019 | |
| WO | WO-2019/084342 | A1 | 5/2019 | |
| WO | WO-2019/140125 | A1 | 7/2019 | |
| WO | WO-2020/006064 | A2 | 1/2020 | |
| WO | WO-2020/006246 | A1 | 1/2020 | |
| WO | WO-2020/014498 | A1 | 1/2020 | |
| WO | WO-2020/061363 | A1 | 3/2020 | |
| WO | WO-2020/092940 | A1 | 5/2020 | |
| WO | WO-2020/118111 | A1 | 6/2020 | |
| WO | WO-2020/132632 | A2 | 6/2020 | |
| WO | WO-2020121219 | A1 | 6/2020 | |
| WO | WO-2020/146372 | A1 | 7/2020 | |
| WO | WO-2020/163251 | A1 | 8/2020 | |
| WO | WO-2020/190363 | A1 | 9/2020 | |
| WO | WO-2020/191201 | A1 | 9/2020 | |
| WO | WO-2020/219893 | A2 | 10/2020 | |
| WO | WO-2020/219932 | A1 | 10/2020 | |
| WO | WO-2020245841 | A1 | 12/2020 | |
| WO | WO-2021/113352 | A1 | 6/2021 | |
| WO | WO-2021/146209 | A1 | 7/2021 | |
| WO | WO-2021221689 | A1 | 11/2021 | |
| WO | WO-2021221690 | A1 | 11/2021 | |
| WO | WO-2021222567 | A2 | 11/2021 | |
| WO | WO-2021222643 | A1 | 11/2021 | |
| WO | WO-2021231449 | A2 | 11/2021 | |
| WO | WO-2022029661 | A1 | 2/2022 | |
| WO | WO-2022140656 | A1 | 6/2022 | |
| WO | WO-2022260676 | A1 | 12/2022 | |
| WO | WO-2022261433 | A1 | 12/2022 | |
| WO | WO-2023278804 | A1 | 1/2023 | |
| WO | WO-2023147050 | A1 | 8/2023 | |
| WO | WO-2023154805 | A2 | 8/2023 | |
| WO | WO-2024006524 | A1 | 1/2024 | |
| WO | WO-2024015230 | A1 | 1/2024 | |
| WO | WO-2025024750 | A2 | 1/2025 | |

OTHER PUBLICATIONS

Swarnalakshmi et al., European Journal of Soil Biology, 55 (2013), pp. 107-116. (Year: 2013).*

Feoktistova et al., Cold Spring Harb Protoc. 2016, 2016(4), pp. 343-347. (Year: 2016).*

Lembre et al., 2012, Chapter 13: "Exopolysaccharides of the Biofilm Matrix: A Complex Biophysical World", edited by Desiree Nedra Karunaratne, The Complex World of Polysaccharides, pp. 371-392, publisher IntechOpen (Year: 2012).*

Fagorzi et al., Microorganisms. 2022., 10, 1777, pp. 1-3 (Year: 2022).*

Leo Daniel, Amalraj E et al., "Effect of Polymeric Additives, Adjuvants, Surfactants on Survival, Stability and Plant Growth Promoting Ability of Liquid Bioinoculants," J Plant Physiol Pathol, 1:2 (2013), 5 pages; http://dx.doi.org/10.4172/jppp.1000105.

Nagy, Zs. K. et al., "Nanofibrous solid dosage form of living bacteria prepared by electrospinning," eXPRESS Polymer Letters, 8(5):352-361 (2014).

(56) References Cited

OTHER PUBLICATIONS

Rojas-Tapias, D. et al., "Preservation of *Azotobacter chroococcum* vegetative cells in dry polymers," Univ. Sci., 20(2):201-207 (2015).
Abd-Elhafeez, E., et al., "Isolation and Characterization of Enterobacter Strains Causing Potato Soft Rot Disease in Egypt," Minia Science Bulletin, Botany Section, Mar. 2018, 29(1), pp. 1-13.
An et al. "Constitutive expression of the nifA gene activates associative nitrogen fixation of Enterobacter gergoviae 57-7, an opportunistic endophytic diazotroph". Journal of Applied Microbiology, Sep. 2007, vol. 103, No. 3, pp. 613-620, doi: 10.1111/j.1365-2672.2007.03289.
Bashan, Y., et al., "Advances in plant growth-promoting bacterial inoculant technology: formulations and practical perspectives (1998-2013)", Plant Soil 2014, 378:1-33, DOI :10.1007/s11104-013-1956-x.
Bashan, Y., et al., "Alginate microbeads as inoculant carriers for plant growth-promoting bacteria", Biology and Fertility of Soils, vol. 35, No. 5, Jun. 2002, pp. 359-368, DOI: 10.1007/s0037 4-002-0481-5.
Batista et al. "Manipulating nitrogen regulation in diazotrophic bacteria for agronomic benefit," Biochemical Society Transactions 2019, vol. 47, pp. 603-614, doi: 10.1042/BST20180342.
Bloch, S. E., et al., Biological nitrogen fixation in maize: optimizing nitrogenase expression in a root-associated diazotroph, Journal of Experimental Botany 2020, vol. 71, No. 15, pp. 4591-4603, doi:10.1093/jxb/eraa176.
Buckley Lab NifH database, retrieved from URL web.archive.org/web/20180110043803/https:/ /blogs.cornell .edu/buckley/nifh-sequence-database/, available on or before Jan. 10, 2018, 2 pages.
Chen M., et al., "Complete genome sequence of Kosakonia sacchari type strain SP1T," Standards in Genomic Sciences 2014, 9:1311-1318, DOI: 10.4056/sigs.5779977.
Clancy, P., et al., "The domains carrying the opposing activities in adenylyl transferase are separated by a central regulatory domain," FEBS Journal (2007), 274:2865-2877.
Common Buffers and Stock Solutions, Current Protocols in Nucleic Acid Chemistry, A.2A.1-A.2A.14, Sep. 2011, DOI: 10.1002/0471142700.nca02as46.
Deaker et al., "Desiccation tolerance of rhizobia when protected by synthetic polymers", Soil Biology and Biochemistry, vol. 39, No. 2, Nov. 29, 2006, pp. 573-580, DOI: 10.1016/j.soilbio.2006.09.005.
Dixon, R. et al. "Genetic regulation of biological nitrogen fixation," Nature Reviews Microbiology, Aug. 2004, vol. 2, pp. 621-631.
European Search Report and Search Opinion, dated Oct. 19, 2022, for European Patent Application No. 19880057.5 (14 total pages).
Examination Report and Search Report, dated May 29, 2023, for Russian Patent Application No. 2021119675 (22 pages).
Examination Report, dated Apr. 30, 2022, for Pakistan Patent Application No. 335/2021 (2 pages).
Examination Report, dated Jun. 9, 2023, for Canadian Patent Application No. 3,120,608 (4 pages).
Extended European Search Report and Search Opinion, dated Oct. 11, 2022, for European Application No. 19892518.2 (8 total pages).
Flores-Núñez, V. M., et al., "Functional Signatures of the Epiphytic Prokaryotic Microbiome of Agaves and Cacti," Frontiers in Microbiology, Jan. 2020, vol. 10, Art. 3044, 13 pages, doi: 10.3389/fmicb.2019.03044.
Giri, K., "The First Report of Indigenous Free-Living Diazotroph Kosakonia sacchari Isolated from Himalayan Alder-Based Shifting Cultivation System in Nagaland, India," Journal of Soil Science and Plant Nutrition 2019, 19, pp. 574-579, https://doi.org/10.1007/s42729-019-00056-5.
Gu, C. T., et al., "Enterobacter xiangfangensis sp. nov., isolated from Chinese traditional sourdough, and reclassification of Enterobacter sacchari Zhu et al. 2013 as Kosakonia sacchari comb. nov.," International Journal of Systematic and Evolutionary Microbiology (2014), 64, 2650-2656, DOI: 10.1099/js.0.064709-0.
Hay, I. D., et al., "Microbial alginate production, modification and its applications," Microbial Biotechnology, vol. 6, No. 6, pp. 637-650, doi: 10.1111/1751-7915.12076 (Nov. 2013).
He, L., et al., "NtrC Is Required for Control of Klebsiella pneumoniae NifL Activity," Journal of Bacteriology, Dec. 1997, vol. 179, No. 23, pp. 7446-7455.
Higdon, S. M., et al., "Genomic characterization of a diazotrophic microbiota associated with maize aerial root mucilage," PLoS ONE, 15(9): e0239677, Sep. 2020, 26 pages, https://doi.org/10.1371/journal.pone.0239677.
Hosseini-Abari, A., et al., "LC/MS detection of oligogalacturonic acids obtained from tragacanth degradation by pectinase producing bacteria," Journal of Basic Microbiology, 2019, 59:249-255, DOI: 10.1002/jobm.201800332.
Hu, L., et al., "Application of bryophyte rhizoid-associated bacteria increases silicon accumulation and growth in maize (*Zea mays* L.) seedlings," App. Ecol. Env. Res., 2019, 17(6):13423-13433, DOI: http://dx.doi.org/10.15666/aeer/1706_1342313433.
International Preliminary Report on Patentability for International Application No. PCT/US2021/029993 dated Nov. 10, 2022, 08 pages.
International Preliminary Report on Patentability for International Application No. PCT/US2022/033002 dated Dec. 21, 2023, 10 pages.
International Preliminary Report on Patentability, mailed Dec. 21, 2023, for International Application No. PCT/US2021/036863, 9 pages.
International Preliminary Report on Patentability, mailed Jun. 17, 2021, for International Application No. PCT/US2019/064782 (9 pages).
International Preliminary Report on Patentability, mailed May 14, 2021, for International Application No. PCT/US2019/059450 (16 pages).
International Search Report and Written Opinion for International Application No. PCT/US2023/062299 dated Aug. 7, 2023, 21 pages.
International Search Report and Written Opinion, mailed Mar. 9, 2022, for International Application No. PCT/US2021/036863, 13 pages.
International Search Report and Written Opinion, mailed Nov. 3, 2022, for International Application No. PCT/US2022/033002, 14 pages.
Invitation to Pay Additional Fees and, Where Applicable, Protest Fee, mailed Jan. 17, 2020, for International Application No. PCT/US2019/059450, 2 pages.
Invitation to Pay Fees for International Application No. PCT/US2023/062299 dated Jun. 16, 2023, 13 pages.
Kiss, S., et al., "Effect of Urease Inhibitors on Other Enyme Activities, Microbial Counts and Biomass as well as on Respiration and Other Microbial Processes in Soils," Chapter 8, Improving Efficiency of Urea Fertilizers by Inhibition of Soil Urease Activity, pp. 321-342 (2002).
Kloepper, J. W., "Development of a Powder Formulation of Rhizobacteria for Inoculation of Potato Seed Pieces", Phytopathology, vol. 71, No. 6, Jan. 1981, pp. 590-592.
Klose, K., et al., "Glutamate at the Site of Phosphorylation of Nitrogen-regulatory Protein NTRC Mimics Aspartyl-Phosphate and Activates the Protein," Journal of Molecular Biology (1993), vol. 232, pp. 67-78.
Liu, J., et al., "Enhancing viability of two biocontrol yeasts in liquid formulation by applying sugar protectant combined with antioxidant," BioControl 2009, 54:817-824, DOI 10.1007/s10526-009-9229-6.
Madhaiyan, M., et al., "Complete Genome Sequence of *Enterobacter* sp. Strain R4-368, an Endophytic N-Fixing Gammaproteobacterium Isolated from Surface-Sterilized Roots of *Jatropha curcas* L.," Genome Announcements, Jul./Aug. 2013, vol. 1, Issue 4, e00544-13, 2 pages.
Mann, E. E., et al., "Pseudomonas biofilm matrix composition and niche biology," FEMS Microbiology Reviews, Jul. 2012, vol. 36, No. 4, pp. 893-916, 41 pages, doi: 10.1111/j.1574-6976.2011.00322.x.
Mosquito, S., et al., "In Planta Colonization and Role of T6SS in Two Rice Kosakonia Endophytes," MPMI 2020, vol. 33, No. 2, pp. 349-363, https://doi.org/10.1094/MPMI-09-19-0256-R.

(56) References Cited

OTHER PUBLICATIONS

Mus, F., et al. Symbiotic Nitrogen Fixation and the Challenges to Its Extension to Nonlegumes. Appl. Environ. Microbiol., Jul. 2016, 82(13):3698-3710.
NCBI GenBank Accession No. JQ001784.1, Enterobacter sacchari strain SP1 16S ribosomal RNA gene, partial sequence, Jul. 23, 2013, 2 pages.
NCBI GenBank Accession No. KY235364.1, Kosakonia sacchari strain 312 16S ribosomal RNA gene, partial sequence, Oct. 31, 2017, 1 page.
NCBI GenBank Accession No. MG196044.1, Kosakonia sacchari strain KhAn 16S ribosomal RNA gene, partial sequence, Feb. 7, 2018, 2 pages.
Nopcharoenkul, W., et al., "The development of a liquid formulation of *Pseudoxanthomonas* sp. RN402 and its application in the treatment of pyrene-contaminated soil," Journal of Applied Microbiology 2011, 111, pp. 36-47, doi:10.1111/j.1365-2672.2011.05037.x.
Notice of Allowance and Search Report, dated Oct. 20, 2023, for Chinese Patent Application No. 201980091416.X, 8 pages.
Office Action, dated Feb. 13, 2023, for Thailand Patent Application No. 2101002976, 6 pages.
Office Action, dated Jan. 26, 2023, for Indonesia Patent Application No. P00202104394, 6 pages.
Office Action, dated Mar. 25, 2023, for Chinese Patent Application No. 201980091416.X (14 pages).
Office Action, dated Oct. 11, 2023, for Japanese Patent Application No. 2021-531992, 11 pages.
Office Action, dated Oct. 14, 2022, for Chinese Patent Application No. 201980091416.X (13 total pages).
Office Action with Search Report for Brazilian Patent Application No. BR112021010947-1 dated Aug. 14, 2023, 8 pages.
Office Action for Canadian Patent Application No. 3172321, dated Nov. 27, 2023, 5 pages.
Ow, D. W., et al., "Promoters regulated by the glnG (ntrC) and nifA gene products share a heptameric consensus sequence in the-15 region," Proc. Natl. Acad. Sci. USA, May 1983, vol. 80, pp. 2524-2528.
Partial European Search Report and Search Opinion, dated Jul. 15, 2022, for European Application No. 19880057.5 (17 total pages).
Pelton, J G, et al., "Solution structure of the DNA-binding domain of NtrC with three alanine substitutions," J. Mol. Biol. 1999, 292, pp. 1095-1110.
Quick, D., "Bacteria-laden silk coating makes seeds suitable for salty soil," New Atlas, Nov. 25, 2019, 3 pages.
Rivarez, M. P. S., et al., "Defense Biopriming and Antimicrobial Activity of Endophytic Bacteria and Associated Bacillus Species Contribute to Bacterial Crown Rot Tolerance in Papaya," bioRxiv 2019, 24 pages, doi: https://doi.org/10.1101/2019.12.22.886341.
Rocha, I., et al., "Seed Coating: A Tool for Delivering Beneficial Microbes to Agricultural Crops," Frontiers in Plant Science, Nov. 2019, vol. 10, Article 1357, 16 pages, doi: 10.3389/fpls.2019.01357.
Salas-Jara, M., et al., "Biofilm Forming Lactobacillus: New Challenges for the Development of Probiotics," Microorganisms 2016, 4, 35, 14 pages, doi: 10.3390/microorganisms4030035.
Schmitz, R. A., et al., Regulation of Nitrogen Fixation in Klebsiella pneumoniae and Azotobacter vinelandii: NifL, Transducing Two Environmental Signals to the nif Transcriptional Activator NifA. J. Mol. Microbiol. Biotechnol. 2002, 4(3): 235-242.
Schoebitz, M., et al., "Bioencapsulation of microbial inoculants for better soil-plant fertilization. A review", Agronomy for Sustainable Development, vol. 33, No. 4, Mar. 27, 2013, pp. 751-765, DOI: 10.1007/S13593-013-0142-0.
Schoug A. et al. Differential effects of polymers PVP90 and Ficoll400 on storage stability and viability of Lactobacillus coryniformis Si3 freeze-dried in sucrose. J Appl Microbial. Mar. 2010; 108(3):1032-1040. doi: 10.1111/j.1365-2672.2009.04506.x.
Shahid, M., et al., "Colonization of Vigna radiata by a halotolerant bacterium Kosakonia sacchari improves the ionic balance, stressor metabolites, antioxidant status and yield under NaCl stress," Applied Soil Ecology 2021, vol. 158, 103809, 14 pages, https://doi.org/10.1016/j.apsoil.2020.103809.
Shinjo, R., et al., "Complete Genome Sequence of Kosakonia sacchari Strain BO-1, an Endophytic Diazotroph Isolated from a Sweet Potato," Genome Announcements, Sep./Oct. 2016, vol. 4, Issue 5, e00868-16, 2 pages.
Strobel, et al., "Industrially-Scalable Microencapsulation of Plant Beneficial Bacterial in Dry Cross-Linked Alginate Matrix," Industrial Biotechnology, vol. 14, No. 3, Jun. 2018, pp. 138-148, DOI: 10.1089/ind.2017.0032.
Temme et al., "Refactoring the nitrogen fixation gene cluster from Klebsiella oxytoca," Proc. Natl. Acad. Sci. USA, May 2012, 109(18):7085-7090.
Tian, H., et al., "Six New Families of Aerobic Arsenate Reducing Bacteria: Leclercia, Raoultella, Kosakonia, Lelliottia, Yokenella, and Kluyvera," Geomicrobiology Journal 2019, vol. 36, No. 4, 339-347, https://doi.org/10.1080/01490451.2018.1554726.
Tu, L., et al., "Preparation and characterization of alginate-gelatin microencapusulated Bacillus subtilis SL-13 by emulsification/internal gelatin," Journal of Biomaterials Science, vol. 26, No. 12, Jul. 10, 2015, pp. 735-749, doi: 10.1080/09205063.2015.1056075.
Volova, T. G., et al., "Microbial Degradation of Polyhydroxyalkanoates with Different Chemical Compositions and Their Biodegradability," Microbial Ecology 2017, vol. 73, pp. 353-367, doi: 10.1007/S00248-016-0852-3.
Vroman, I., et al., "Biodegradable Polymers," Materials 2009, 2, 307-344, doi:10.3390/ma2020307.
Wang, C., et al., "*Kosakonia quasisacchari* sp. nov. recovered from human wound secretion in China," International Journal of Systemic and Evolutionary Microbiology, 2019, 69:3155-3160, DOI 10.1099/ijsem.0.003606.
Wang, W. et al., "Screening, Identification and Growth Promotion Ability of Phosphate Solubilizing Bacteria from Soybean Rhizosphere under Maize-Soybean Intercropping Systems," bioRxiv 2020, 25 pages, doi: https://doi.org/10.1101/2020.12.15.422997.
Wang, X., et al., "Emergence of a novel mobile colistin resistance gene, mcr-8, in NDM-producing Klebsiella pneumoniae, " Emerging Microbes & Infections 2018, 7:122, 10 pages, DOI 10.1038/s41426-018-0124-z.
Watson, C. J., "Urease Activity and Inhibition—Principles and Practice," Proceedings, No. 454, pp. 1-40, presented to The International Fertiliser Society, London, Nov. 28, 2000.
Witkowski, A. et al., "Conversion of a β-Ketoacyl Synthase to a Malonyl Decarboxylase by Replacement of the Active-Site Cysteine with Glutamine," Biochemistry 1999, 38, pp. 11643-11650.
Wu, et al., "Effects of different amendments on contents of phenolic acids and specific microbes in rhizo-sphere of Pseudostellaria heterophylla," Chinese Journal of Applied Ecology, Nov. 2016, 27(11): 3623-3630, DOI: 10.13287/j.1001-9332.201611.004 (English abstract only).
Wu, et al., "Mixed Phenolic Acids Mediated Proliferation of Pathogens Talaromyces helicus and Kosakonia sacchari in Continuously Monocultured Radix pseudostellariae Rhizosphere Soil," Frontiers in Microbiology, Mar. 2016, vol. 7, Article 335, 14 pages, doi: 10.3389/fmicb.2016.00335.
Wu, H., et al., "Insights into the Mechanism of Proliferation on the Special Microbes Mediated by Phenolic Acids in the Radix pseudostellariae Rhizosphere under Continuous Monoculture Regimes," Frontiers in Plant Science, May 2017, vol. 8, Article 659, 15 pages, DOI: 10.3389/fpls.2017.00659.
Wu, H., et al., "The role of organic acids on microbial deterioration in the Radix pseudostellariae rhizosphere under continuous monoculture regimes," Scientific Reports, 7:3497, 13 pages, published online Jun. 14, 2017, doi: 10.1038/s41598-017-03793-8.
Zehr lab NifH database, https://wwwzehr.pmc.ucsc.edu/nifH_Database_Public/nifH.Database.Archives/, Apr. 4, 2014 (8 total pages).
Zhang et al., "Mutagenesis and functional characterization of the four domains of GlnD, a bifunctional nitrogen sensor protein," Journal of Bacteriology, Jun. 2010, 192(11):2711-2721.
Zhu, B., et al., "*Enterobacter sacchari* sp. nov., a nitrogen-fixing bacterium associated with sugar cane (*Saccharum officinarum* L.),"

(56) References Cited

OTHER PUBLICATIONS

International Journal of Systemic and Evolutionary Microbiology (2013), 63, 2577-2582, DOI 10.1099/ijs.0.045500-0.
Zhu, B., et al., "Genome Sequence of *Enterobacter* sp. Strain SP1, an Endophytic Nitrogen-Fixing Bacterium Isolated from Sugarcane," J. Bacterial., Dec. 2012, vol. 194, No. 24, pp. 6963-6964, doi:10.1128/JB.01933-12.
International Search Report and Written Opinion mailed Apr. 16, 2020 for International Application No. PCT/US2019/064782, 13 pages.
International Search Report and Written Opinion mailed Mar. 10, 2020 for International Application No. PCT/US2019/059450, 20 pages.
International Search Report and Written Opinion mailed Sep. 15, 2021 for International Application No. PCT/US2021/029993, 11 pages.
Arriel-Elias, M. T. et al., "Shelf life enhancement of plant growth promoting rhizobacteria using a simple formulation screening method," African Journal of Microbiology Research, 12(5):115-126 (2018).
Bali, A. et al., "Excretion of ammonium by a nifL mutant of Azotobacter vinelandii fixing nitrogen," Appl Environ Microbiol, 58(5):1711-1718 (1992); doi: 10.1128/aem.58.5.1711-1718.1992.
Berninger, T. et al., "Maintenance and assessment of cell viability in formulation of non-sporulating bacterial inoculants," Microb Biotechnol, 11(2):277-301 (2018); doi:10.1111/1751-7915.12880.
Blanco, G. et al., "Sequence and molecular analysis of the nifL gene of Azotobacter vinelandii," Mol Microbiol, 9(4):869-879 (1993); doi: 10.1111/j.1365-2958.1993.tb01745.x.
Baum, J. A. et al., "Control of coleopteran insect pests through RNA interference," Nature Biotechnology, 25(11):1322-1326 (2007).
Bosmans, F. & Tytgat, J., "Sea anemone venom as a source of insecticidal peptides acting on voltage-gated Na+ channels," Toxicon, 49(4):550-560 (2007).
Butzen, S., "Corn Seeding Rate Considerations," Mar. 2019, 4 pages; www.pioneer.com/home/site/us/agronomy/library/corn-seeding-rate-considerations/.
CERA GM Crop Database Center for Environmental Risk Assessment (CERA), ILSI Research Foundation, Washington, DC, 2010, Web Page, 1 page; http://cera-gmc.org/index.ph/?action=gm_crop_database.
Chakroun, M. et al., "Bacterial Vegetative Insecticidal Proteins (Vip) from Entomopathogenic Bacteria," Microbiology and Molecular Biology Reviews, 80(2):329-350 (2016).
Chiang, L. W. et al., "Mutagenic Oligonucleotide-directed PCR Amplification (Mod-PCR): An Efficient Method for Generating Random Base Substitution Mutations in a DNA Sequence Element," PCR Methods and Applications, 2(3):210-217 (1993); doi: 10.1101/gr.2.3.210.
Colby, S. R., "Calculating Synergistic and Antagonistic Responses of Herbicide Combinations," Weeds, 15(1):20-22 (1967).
Costerton, J. W. et al., "Microbial Biofilms," Annu. Rev. Microbiol., 49:711-45 (1995).
Crickmore, N. et al., "Revision of the Nomenclature for the *Bacillus thuringiensis* Pesticidal Crystal Proteins," Microbiol. Mol. Biol. Rev., 62(3):807-813 (1998).
Da Silva, M. F. et al., "Survival of endophytic bacteria in polymer-based inoculants and efficiency of their application to sugarcane," Plant Soil, 356:231-243 (2012).
Davin-Regli, A. & Pagès, "Enterobacter aerogenes and Enterobacter cloacae; versatile bacterial pathogens confronting antibiotic treatment," Frontiers in Microbiology, 6:392 (2015), 10 pages; Published online May 18, 2015. doi: 10.3389/fmicb.2015.00392.
Eyraud, V. et al., "Expression and Biological Activity of the Cystine Knot Bioinsecticide PA1b (Pea Albumin 1 Subunit b)," PLoS One, 8(12): e81619 (2013), 9 pages; doi:10.1371/journal.pone.0081619.
Gaby, J. C. & Buckley, D. H., "A comprehensive aligned nifH gene database: a multipurpose tool for studies of nitrogen-fixing bacteria," Database, vol. 2014: article ID bau001, 8 pages (2014). doi:10.1093/database/bau001.
Hoeschle-Zeledon, I. et al., "Regulatory challenges for biological control," The CGIAR Systemwide Program on Integrated Pest Management, Jan. 2013, SP-IPM Secretariat, International Institute of Tropical Agriculture (IITA), Ibadan, Nigeria, 53 pages.
Hidaka, M. et al., "Promotion of the Growth of Rice by Inoculation of Nitrogen-Fixing-Activity-Enhanced Bacteria to the Rhizosphere," Nitrogen Fixation: From Molecules to Crop Productivity, p. 445 (Jan. 1, 2002).
Jahn, A. & Nielsen, P. H., "Extraction of Extracellular Polymeric Substances (EPS) from Biofilms Using a Cation Exchange Resin," Wat. Sci. Tech., 32(8):157-164 (1995).
Kabaluk, J. T. et al. (ed.), 2010. "The use and regulation of microbial pesticides in representative jurisdictions worldwide," IOBC Global, 99 pages. Available online at www.IOBC-Global.org.
Kant, S. et al., "Understanding plant response to nitrogen limitation for the improvement of crop nitrogen use efficiency," Journal of Experimental Botany, 62(4):1499-1509 (2011).
Kim, Y. et al., "Constitutive expression of nitrogenase system in Klebsiella oxytoca by gene targeting mutation to the chromosomal nifLA operon," Journal of Biotechnology, 10(3-4):293-301 (1989).
King, G. F. & Hardy, M. C., "Spider-Venom Peptides: Structure, Pharmacology, and Potential for Control of Insect Pests," Annu. Rev. Entomol., 58:475-496 (2013).
Lin, P. et al., "PC, A Novel Oral Insecticidal Toxin from Bacillus bombysepticus Involved in Host Lethality via APN and BtR-175," Scientific Reports, 5:11101 (2015), 14 pages; doi:10.1038/srep11101.
Mao, Y.-B. et al., "Silencing a cotton bollworm P450 monooxygenase gene by plant-mediated RNAi impairs larval tolerance of gossypol," Nature Biotechnology, 25(11):1307-1313 (2007).
Martinelli, A. H. S. et al., "Structure-function studies on jaburetox, a recombinant insecticidal peptide derived from jack bean (*Canavalia ensiformis*) urease," Biochimica et Biophysica Acta, 1840:935-944 (2014).
Marx, C. J. et al., "Broad-Host-Range cre-lox System for Antibiotic Marker Recycling in Gram-Negative Bacteria," Biotechniques;33(5):1062-1067 (Nov. 1, 2002); doi: 10.2144/02335rr01.
Mengel, D., "Roots, Growth and Nutrient Uptake," Dept. of Agronomy publication #AGRY-95-08 (Rev. May 1995), 8 pages.
Naimov, S. et al., "Solubilization, Activation, and Insecticidal Activity of *Bacillus thuringiensis* Serovar thompsoni HD542 Crystal Proteins," Appl. Environ. Microbiol., 74(23):7145-7151 (2008).
Nestmann, E. R., "Mutagenesis by nitrosoguanidine, ethyl methanesulfonate, and mutator gene mutH in continuous cultures of *Escherichia coli*," Mutation Research, 28:323-330 (1975).
Nielsen, P. H. & Jahn, A., "Extraction of EPS," In: Wingender J., Neu T.R., Flemming HC. (eds) Microbial Extracellular Polymeric Substances. Springer, Berlin, Heidelberg (1999); https://doi.org/10.1007/978-3-642-60147-7_3.
Nielsen, P. H. et al., "Conceptual model for production and composition of exopolymers in biofilms," Wat. Sci. Tech., 36(1):11-19 (1997).
Nita, P. et al., "Liquid formulations of *Acetobacter diazotrophicus* L1 and *Herbaspirillum seropedicae* J24 and their field trials on wheat," International Journal of Environmental Science, 3(3):1116-1129 (2012).
Parker, M. W. et al., "Pore-forming protein toxins: from structure to function," Progress in Biophysics & Molecular Biology, 88:91-142 (2005).
Purcell, J. P. et al., "Cholesterol Oxidase: A Potent Insecticidal Protein Active Against Boll Weevil Larvae," Biochemical and Biophysical Research Communications, 196(3):1406-1403 (1993).
Qaim, M. & Zilberman, M., "Yield Effects of Genetically Modified Crops in Developing Countries," Science, 299(5608):900-902 (2003); doi:10.1126/science.1080609.
Qiu, D.-Y. & Shen, B.-F., "Construction of Genetically Engineered Strains of Enterobacter Cloacae (nifL—Ac)," Acta Phytophysiologica Sinica, 25(3):269-273 (1999). English translation.
Rakhee, D. S. et al., "Extracellular polymeric substances of the marine fouling diatom *Amphora rostrata* Wm.Sm," Biofouling, 17(2):117-127 (201).

(56) References Cited

OTHER PUBLICATIONS

Sanahuja, G. et al., "*Bacillus thuringiensis*: a century of research, development and commercial applications," Plant Biotechnology Journal, 9:283-300 (2011).
Schuler, T. H. et al., "Insect-resistant transgenic plants," Trends in Biotechnology, 16(4):168-175; https://doi.org/10.1016/S0167-7799(97)01171-2.
Shamseldin, A., "The Role of Different Genes Involved in Symbiotic Nitrogen Fixation—Review," Global Journal of Biotechnology & Biochemistry, 8(4):84-94 (2013).
Stemmer, W. P., "DNA shuffling by random fragmentation and reassembly: In vitro recombination for molecular evolution," Proc. Natl. Acad. Sci. USA, 91:10747-10751 (1994).
Stemple, D. L., "TILLING—a high-throughput harvest for functional genomics," Nature Reviews Genetics, 5(2):145-50 (2004); doi: 10.1038/nrg1273.
Tijssen, P., "Hybridization with Nucleic Acid Probes, Part I: Theory and Nucleic Acid Preparation," Laboratory Techniques in Biochemistry and Molecular Biology, vol. 24, 1993, 68 pages.
Wang, D. et al., "Biofilm formation enables free-living nitrogen-fixing rhizobacteria to fix nitrogen under aerobic conditions," The ISME Journal, 11:1602-1613 (2017).
Wimpenny, J. et al., "Community structure and co-operation in biofilms," 59th Symposium of the Society for General Microbiology, D.G. Allison, P. Gilbert, H.M. Lappin-Scott and M. Wilson, Eds., 2000, 23 pages.
Yarza, P. et al., "Uniting the classification of cultured and uncultured bacteria and archaea using 16S rRNA gene sequences," Nature Reviews Microbiology, 12:635-645 (2014).
First Office Action and Search Report dated Mar. 3, 2022 for Chinese Application No. 201980091416.X, with English language translation, 17 pages.
Furtado, G.Q., et al., "First Report of Enterobacter cowanii Causing Bacterial Spot on Mabea fistulifera, a Native Forest Species in Brazil," Plant Disease, published online Sep. 5, 2012, 2 pages, https://doi.org/10.1094/PDIS-02-12-0160-PDN.
Han, Y. et al., "Kosakonia cowanii, a new bacterial pathogen affecting foxtail millet (*Setaria italica*[L.]P. Beauv.) in China," Microbial Pathogenesis, vol. 181, Aug. 2023, 106201, 8 pages, https://doi.org/10.1016/j.micpath.2023.106201.
Krawczyk, K. and Borodynko-Filas, N., "Kosakonia cowanii as the New Bacterial Pathogen Affecting Soybean (Glycine max Willd.).," Eur J Plant Pathol 2020, 157: 173-183, published online May 5, 2020, https://doi.org/10.1007/s10658-020-01998-8.
Office Action, dated Apr. 16, 2025, for Australian Patent Application No. 2019394973, 5 pages.
Non-Final Office Action for U.S. Appl. No. 17/299,871 dated Jan. 13, 2025, 9 pages.
Examination report for Australian Patent Application No. 2019394973 dated Oct. 4, 2024, 4 pages.
Martinez-Romero E., et al., "Draft Genome Sequences of Klebsiella variicola Plant Isolates," Genome Announcements, Sep./Oct. 2015, vol. 3, Issue 5, e01015-15, pp. 1-2.
Office Action for Canadian Patent Application No. 3120608 dated Nov. 22, 2024, 8 pages.
Amiet-Charpentier, C., et al., "Rhizobacteria microencapsulation: properties of microparticles obtained by spray-drying," Journal of Microencapsulation 1999, vol. 16, No. 2, pp. 215-229, https://doi.org/10.1080/026520499289194.
Berninger, T., et al., "Zeolite-based, dry formulations for conservation and practical application of Paraburkholderia phytofirmans PsJN," Journal of Applied Microbiology 2017, 122: 974-986.
Bisutti I. L., et al., "Influence of different growth conditions on the survival and the efficacy of freeze-dried Pseudomonas fluorescens strain Pf153," Biocontrol Science and Technology 2015, vol. 25, No. 11, pp. 1269-1284, http://dx.doi.org/10.1080/09583157.2015.1044498.
Bonaterra, A., et al., "Increasing survival and efficacy of a bacterial biocontrol agent of fire blight of rosaceous plants by means of osmoadaptation," FEMS Microbiol Ecol 2007, 61: 185-195, DOI:10.1111/j.1574-6941.2007.00313.x.
Cabrefiga, J., et al., "Improvement of fitness and efficacy of a fire blight biocontrol agent via nutritional enhancement combined with osmoadaptation," Applied and Environmental Microbiology, May 2011, vol. 77, No. 10, pp. 3174-3181, doi: 10.1128/AEM.02760-10.
Costa E, et al., "Effect of protective agents, rehydration media and initial cell concentration on viability of Pantoea agglomerans strain CPA-2 subjected to freeze-drying," Journal of Applied Microbiology 2000, 89, 793-800.
Costa, E., et al., "Survival of Pantoea agglomerans strain CPA-2 in a spray-drying process," Journal of Food Protection 2002, vol. 65, No. 1, pp. 185-191.
Costa, E., et al., "Effect of package and storage conditions on viability and efficacy-of the freeze-dried biocontrol agent Pantoea agglomerans strain CPA-2," Journal of Applied Microbiology 2002, 92, pp. 873-878.
Dandurand, L. M., et al., "Survival of *Pseudomonas* spp. in air-dried mineral powders," Soil Biol Biochem 1994 , vol. 26, No. 10, pp. 1423-1430.
Jean-Noel, M. K., et al., "Accelerated storage testing of freeze-dried Pseudomonas fluorescens BTP1, BB2 and PI9 strains," African Journal of Biotechnology, Nov. 27, 2012, vol. 11(95), pp. 16187-16191, DOI: 10.5897/AJB12.2370.
Joe, M. M., et al., "Survival of Azospirillum brasilense flocculated cells in alginate and its inoculation effect on growth and yield of maize under water deficit conditions," European Journal of Soil Biology 2012, 50: 198-206, doi:10.1016/j.ejsobi.2012.03.002.
Moenne-Loccoz, Y., et al., "Effect of inoculum preparation and formulation on survival and biocontrol efficacy of Pseudomonas fluorescens F113," Journal of Applied Microbiology 1999, 86, pp. 108-116.
Schisler, D. A., et al., "Appraisal of selected osmoprotectants and carriers for formulating Gram-negative biocontrol agents active against Fusarium dry rot on potatoes in storage," Biological Control 2016, 98, 1-10, http://dx.doi.org/10.1016/j.biocontrol.2016.03.009.
Schoebitz, M., et al., "Starch filler and osmoprotectants improve the survival of rhizobacteria in dried alginate beads," Journal of Microencapsulation 2012, 29(6): 532-538, DOI: 10.3109/02652048.2012.665090.
Segarra, G., et al., "Stepwise flow diagram for the development of formulations of non spore-forming bacteria against foliar pathogens: The case of Lysobacter capsici AZ78," Journal of Biotechnology 2015, 216: 56-64, dx.doi.org/10.1016/j.jbiotec.2015.10.004.
Slininger, P.J., and Schisler, D.A., "High-throughput assay for optimising microbial biological control agent production and delivery," Biocontrol Science and Technology 2013, vol. 23, No. 8, 920-943, http://dx.doi.org/10.1080/09583157.2013.808739.
Slininger, P.J., et al., "Multi-strain co-cultures surpass blends for broad spectrum biological control of maladies of potatoes in storage," Biocontrol Science and Technology 2010, vol. 20, No. 8, pp. 763-786, DOI: 10.1080/09583151003717201.
Slininger, P.J., et al., "Polysaccharide production benefits dry storage survival of the biocontrol agent Pseudomonas fluorescens S11:P:12 effective against several maladies of stored potatoes," Biocontrol Science and Technology 2010, vol. 20, No. 3, pp. 227-244, DOI: 10.1080/09583150903469525.
Streeter, J. G., "Effect of trehalose on survival of Bradyrhizobium japonicum during desiccation," Journal of Applied Microbiology 2003, 95, pp. 484-491, doi:10.1046/j.1365-2672.2003.02017.x.
Bageshwar, U. K., "Studies on Some Nitrogen Fixing Genes of Azotobacter Vinelandii," Thesis submitted to the Jamia Millia Isamia for the award of Degree of Doctor of Philosophy, Department of Biosciences, Faculty of Natural Sciences, Jamia Millia Islamia, New Delhi, Aug. 1994, 254 pages.
Chaurasia, A. K., et al., "Improved Eco-Friendly Recombinant *Anabaena* sp. Strain PCC7120 with Enhanced Nitrogen Biofertilizer Potential," Applied and Environmental Microbiology, Jan. 2011, vol. 77, No. 2, pp. 395-399, doi:10.1128/AEM.01714-10.
Peralta, H., et al., "Engineering the nifH Promoter Region and Abolishing Poly—Hydroxybutyrate Accumulation in Rhizobium

(56) References Cited

OTHER PUBLICATIONS etli Enhance Nitrogen Fixation in Symbiosis with Phaseolus vulgaris," Applied and Environmental Microbiology, Jun. 2004, vol. 70, No. 6, pp. 3272-3281.
Rosenblueth, Mónica, et al. "Klebsiella variicola, a novel species with clinical and plant-associated isolates." Systematic and applied microbiology 27(1):27-35 (2004).
Simon, H. M., et al., "Importance of cis Determinants and Nitrogenase Activity in Regulated Stability of the Klebsiella pneumoniae Nitrogenase Structural Gene mRNA," Journal of Bacteriology, Jun. 1999, vol. 181, No. 12, pp. 3751-3760.
Examination report for Canadian Patent Application No. 3,172,321 dated May 1, 2025, 5 pages.
Restriction Requirement, dated May 12, 2025, for U.S. Appl. No. 18/050,698, 8 pages.
Non-Final Office Action for U.S. Appl. No. 17/299,871 dated Jul. 17, 2025, 21 pages.
Notice of Acceptance for Australian Patent Application No. 2019394973 dated Jul. 17, 2025, 3 pages.
Mexican Patent Application No. MX/a/2021/006708, Office Action dated Sep. 30, 2025; Pivot Bio, Inc., with English translation; 16 total pages.
U.S. Appl. No. 18/050,698, Notice of Allowance mailed Aug. 15, 2025; Inventor Rezaei, Farzaneh et al.; 17 pages.
U.S. Appl. No. 19/367,462, filed Oct. 23, 2025; Inventor Rezaei, Farzaneh et al.
CA Application No. 3120608, Office Action dated Feb. 6, 2026; Applicant Pivot Bio, Inc.; 5 total pages.
IN Application No. 202117027270, Office Action dated Jun. 4, 2026; Applicant Pivot Bio, Inc.; 11 total pages.
MX Application No. MX/a/2021/006708, Notice of Allowance dated Dec. 4, 2025; Applicant Pivot Bio, Inc.; with English translation 6 total pages.
U.S. Appl. No. 17/299,871, Final Office Action dated Feb. 17, 2026; Inventor Rezaei, Farzaneh et al.; 20 pages.
CN Application No. 202311831717.6, Office Action and Search report dated Aug. 3, 2026; Applicant Pivot Bio, Inc.; with machine English translation 26 pages.
Jing et al., "Advances in Biochemical Genetics of Nitrogen Fixation I," China Bulletin of Botany, (1984), Issue I; with partial English translation 14 pages.
Zhao et al., "Paenibacillus massiliensis T7 nitrogen fixation gene cluster cloning, sequence analysis, and ammonium of nifBHDKENX regulation of the nifB promoter by oxygen," Science in China Series C, Life Sciences, 35(5): 424-432; with machine English translation 18 pages.

* cited by examiner

Stability of 137-1036 formulation after 1-week storage at 25°C and 37°C

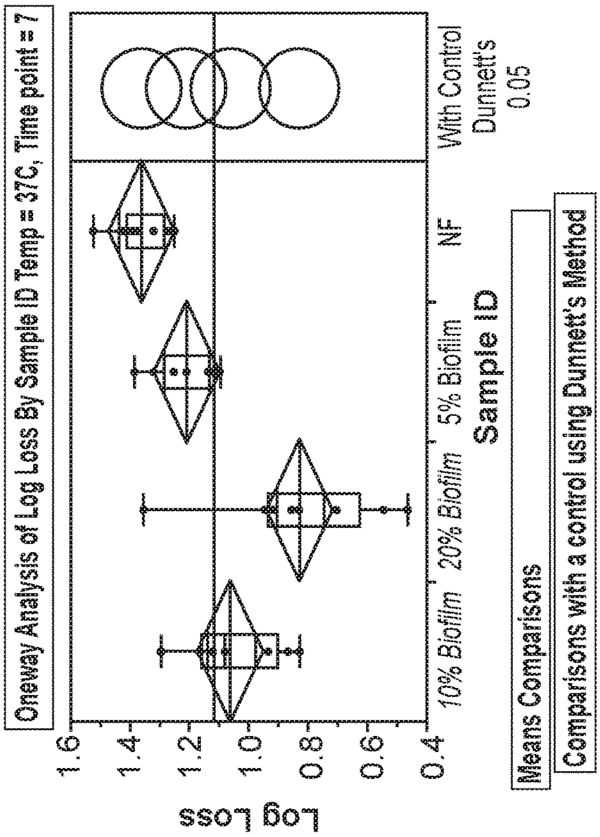

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif)-LSD | p-Value |
|---|---|---|
| NF | -0.19 | 1.0000 |
| 5% Biofilm | -0.04 | 0.1327 |
| 10% Biofilm | 0.115 | 0.0011* |
| 20% Biofilm | 0.345 | <.0001* |

Positive values show pairs of means that are significantly different.

FIG. 2B

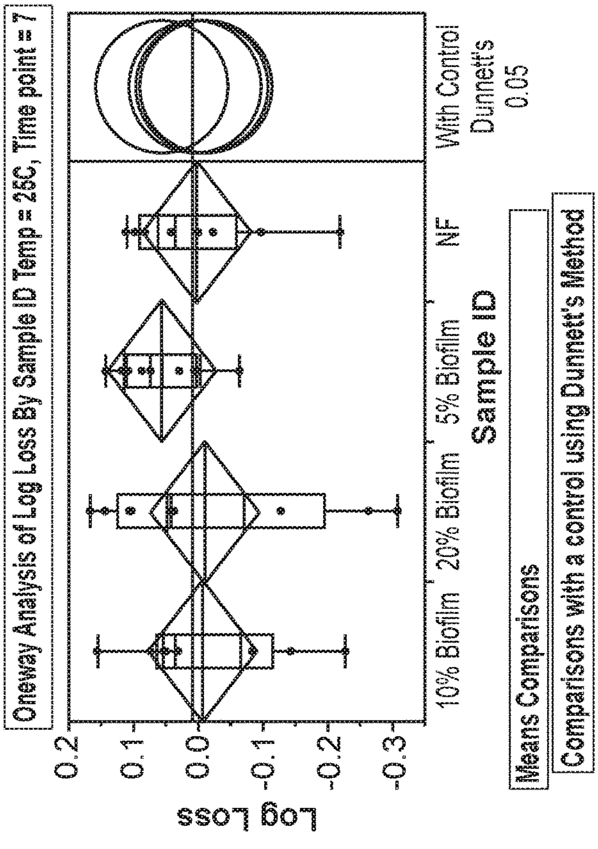

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif)-LSD | p-Value |
|---|---|---|
| 5% Biofilm | -0.09 | 0.7106 |
| NF | -0.14 | 1.0000 |
| 10% Biofilm | -0.13 | 09960 |
| 20% Biofilm | -0.13 | 09889 |

Positive values show pairs of means that are significantly different.

FIG. 2A

Stability of 137-1036 formulation after 2-weeks storage at 25°C and 37°C

Oneway Analysis of Log Loss By Sample ID Temp = 25C, Time point = 14

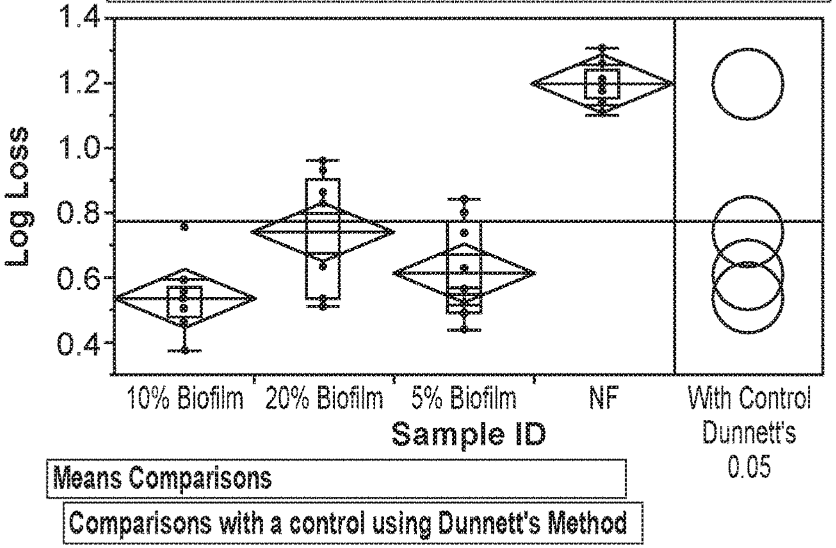

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif) -LSD | p-Value |
|---|---|---|
| NF | -0.15 | 1.0000 |
| 20% Biofilm | 0.303 | <.0001* |
| 5% Biofilm | 0.434 | <.0001* |
| 10% Biofilm | 0.51 | <.0001* |

Positive values show pairs of means that are significantly different.

FIG. 3A

Oneway Analysis of Log Loss By Sample ID Temp = 37C, Time point = 14

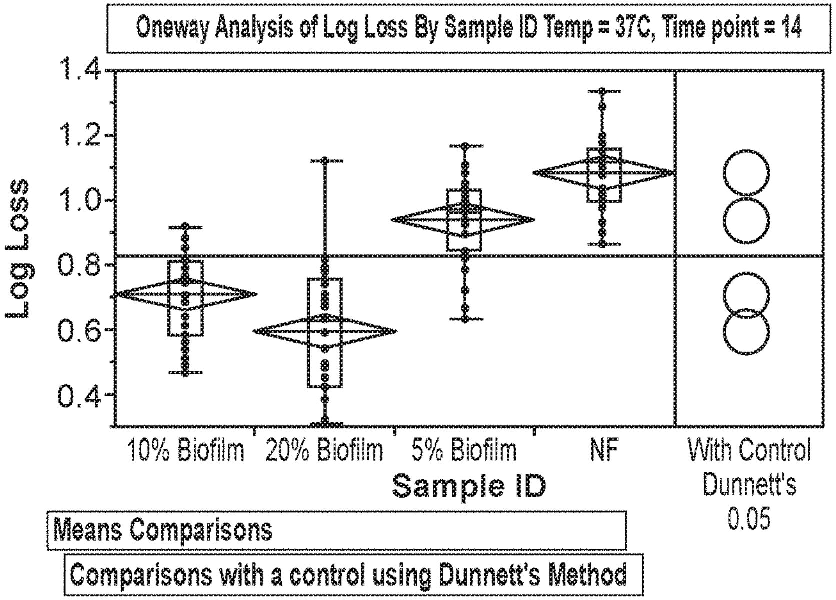

Means Comparisons

Comparisons with a control using Dunnett's Method

Control Group = NF

Confidence Quantile

| \|d\| | Alpha |
|---|---|
| 2.38381 | 0.05 |

LSD Threshold Matrix

| Level | Abs(Dif) -LSD | p-Value |
|---|---|---|
| NF | -0.09 | 1.0000 |
| 5% Biofilm | 0.054 | 0.0009* |
| 10% Biofilm | 0.283 | <.0001* |
| 20% Biofilm | 0.396 | <.0001* |

Positive values show pairs of means that are significantly different.

FIG. 3B

Stability of 137-1034 formulation after 1-week storage at 25°C and 37°C

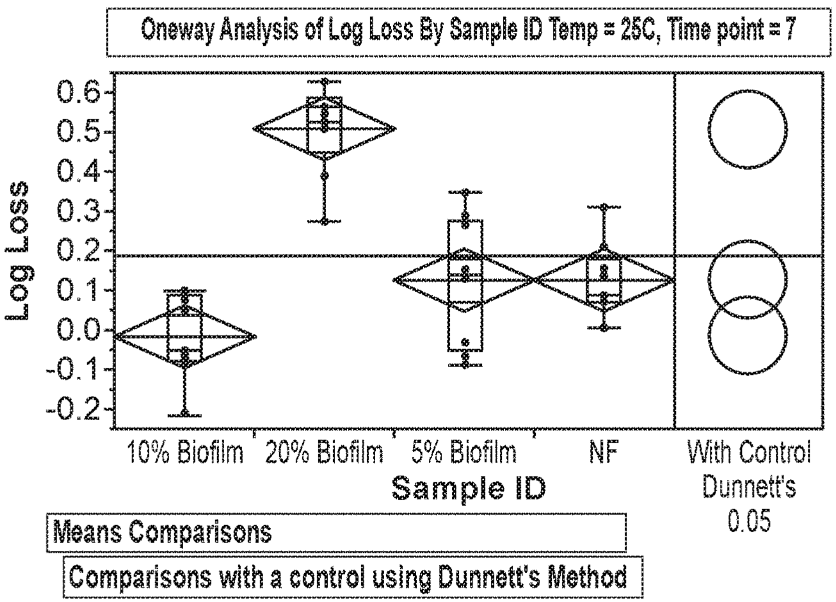

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif) -LSD | p-Value |
|---|---|---|
| 20% Biofilm | 0.243 | <.0001* |
| 5% Biofilm | -0.14 | 1.0000 |
| NF | -0.14 | 1.0000 |
| 10% Biofilm | 0.005 | 0.0417* |

Positive values show pairs of means that are significantly different.

FIG. 4A

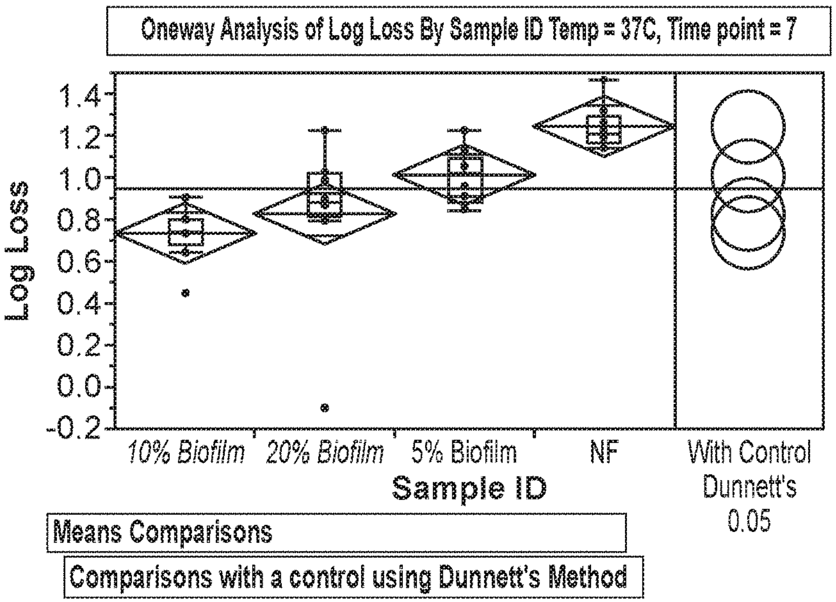

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif) -LSD | p-Value |
|---|---|---|
| NF | -0.25 | 1.0000 |
| 5% Biofilm | -0.01 | 0.0665 |
| 10% Biofilm | 0.168 | 0.0007* |
| 20% Biofilm | 0.261 | <.0001* |

Positive values show pairs of means that are significantly different.

FIG. 4B

Stability of 137-1034 formulation after 2-weeks storage at 25°C and 37°C

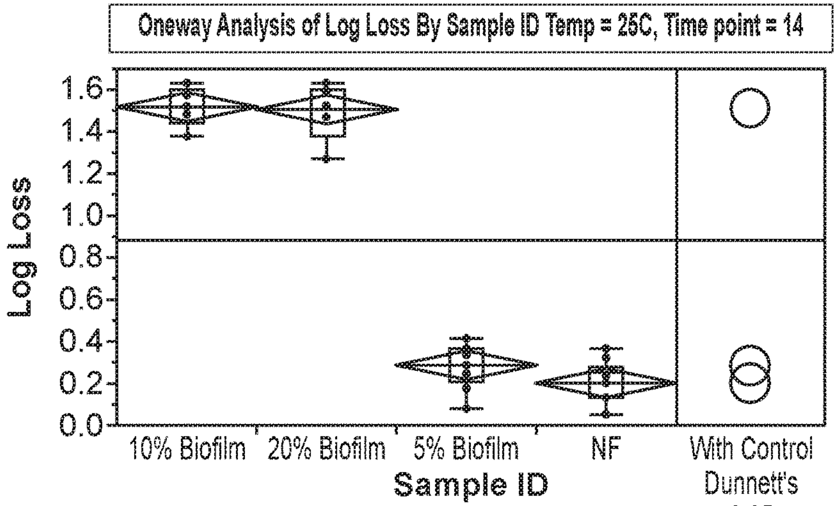

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif)-LSD | p-Value |
|---|---|---|
| 10% Biofilm | 1.188 | <.0001* |
| 20% Biofilm | 1.179 | <.0001* |
| 5% Biofilm | -0.04 | 0.2586 |
| NF | -0.13 | 1.0000 |

Positive values show pairs of means that are significantly different.

FIG. 5A

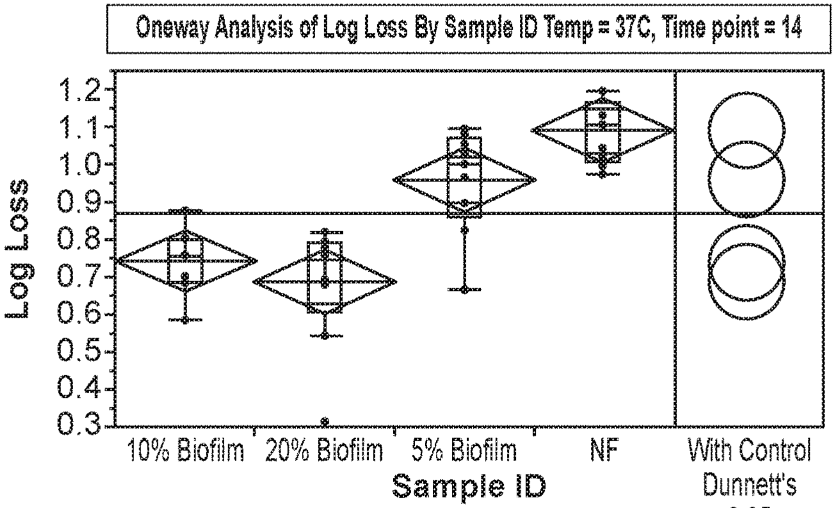

Means Comparisons

Comparisons with a control using Dunnett's Method

Control Group = NF

Confidence Quantile

| \|d\| | Alpha |
|---|---|
| 2.46557 | 0.05 |

LSD Threshold Matrix

| Level | Abs(Dif)-LSD | p-Value |
|---|---|---|
| NF | -0.14 | 1.0000 |
| 5% Biofilm | -0.01 | 0.0780 |
| 10% Biofilm | 0.205 | <.0001* |
| 20% Biofilm | 0.261 | <.0001* |

Positive values show pairs of means that are significantly different.

FIG. 5B

BIOFILM COMPOSITIONS WITH IMPROVED STABILITY FOR NITROGEN FIXING MICROBIAL PRODUCTS

CROSS-REFERENCE TO RELATED APPLICATIONS

This application claims the benefit of International PCT Application No. PCT/US2019/059450, filed Nov. 1, 2019, which claims priority to U.S. Provisional Application No. 62/754,468, filed on Nov. 1, 2018. These applications are hereby incorporated by reference in their entirety for all purposes.

STATEMENT REGARDING SEQUENCE LISTING

The contents of the text file submitted electronically herewith are incorporated herein by reference in their entirety: A computer readable format copy of the Sequence Listing filename: PIVO_010_02US_SeqList_ST25.txt, date created, Apr. 21, 2021, file size ~647,686 bytes.

BACKGROUND OF THE DISCLOSURE

By 2050 the United Nations' Food and Agriculture Organization projects that total food production must increase by 70% to meet the needs of a growing population, a challenge that is exacerbated by numerous factors, including: diminishing freshwater resources, increasing competition for amble land, rising energy prices, increasing input costs, and the likely need for crops to adapt to the pressures of a drier, hotter, and more extreme global climate.

Current agricultural practices are not well equipped to meet this growing demand for food production, while simultaneously balancing the environmental impacts that result from increased agricultural intensity.

One of the major agricultural inputs needed to satisfy global food demand is nitrogen fertilizer. However, the current industrial standard utilized to produce nitrogen fertilizer, is an artificial nitrogen fixation method called the Haber-Bosch process, which converts atmospheric nitrogen ($N_2$) to ammonia ($NH_3$) by a reaction with hydrogen ($H_2$) using a metal catalyst under high temperatures and pressures. This process is resource intensive and deleterious to the environment.

In contrast to the synthetic Haber-Bosch process, certain biological systems have evolved to fix atmospheric nitrogen. These systems utilize an enzyme called nitrogenase that catalyzes the reaction between $N_2$ and $H_2$, and results in nitrogen fixation. For example, *rhizobia* are diazotrophic bacteria that fix nitrogen after becoming established inside root nodules of legumes. An important goal of nitrogen fixation research is the extension of this phenotype to non-leguminous plants, particularly to important agronomic grasses such as wheat, rice, and corn. However, despite the significant progress made in understanding the development of the nitrogen-fixing symbiosis between rhizobia and legumes, the path to use that knowledge to induce nitrogen-fixing nodules on non-leguminous crops is still not clear.

Consequently, the vast majority of modern row crop agriculture utilizes nitrogen fertilizer that is produced via the resource intensive and environmentally deleterious Haber-Bosch process. For instance, the USDA indicates that the average U.S. corn farmer typically applies between 130 and 200 lb. of nitrogen per acre (146 to 224 kg/ha). This nitrogen is not only produced in a resource intensive synthetic process, but is applied by heavy machinery crossing/impacting the field's soil, burning petroleum, and requiring hours of human labor.

Furthermore, the nitrogen fertilizer produced by the industrial Haber-Bosch process is not well utilized by the target crop. Rain, runoff, heat, volatilization, and the soil microbiome degrade the applied chemical fertilizer. This equates to not only wasted money, but also adds to increased pollution instead of harvested yield. To this end, the United Nations has calculated that nearly 80% of fertilizer is lost before a crop can utilize it. Consequently, modern agricultural fertilizer production and delivery is not only deleterious to the environment, but it is extremely inefficient.

While improved microbes capable of fixing atmospheric nitrogen are desirable, methods of preserving the microbes or extending the natural viability of the microbes are further desirable. Biofilms confer a resilience to bacteria in contact with the biofilms, extending the normal viability of bacteria under standard conditions and even otherwise bactericidal conditions.

In order to meet the world's growing food supply needs—while also balancing resource utilization and providing minimal impacts upon environmental systems—a better approach to nitrogen fixation and delivery to plants is urgently needed.

SUMMARY OF THE DISCLOSURE

In some aspects, the disclosure is drawn to a composition comprising (i) one or more isolated bacteria, and (ii) one or more biofilms produced by one or more microbes; wherein the one or more biofilms are exogenous to the one or more isolated bacteria.

In some aspects, the one or more isolated bacteria are selected from species of *Achromobacter, Agrobacterium, Anabaena, Azorhizobium, Azospirillum, Azotobacter, Bacillus, Bradyrhizobium, Candida, Clostridium, Enterobacter, Klebsiella, Kluyvera, Kosakonia, Mesorhizobium, Microbacterium, Pseudomonas, Rahnella, Rhizobium, Saccharomyces*, and *Sinorhizobium.*

In some aspects, the one or more isolated bacteria are selected from: *Achromobacter marplatensis, Achromobacter spiritinus, Azospirillum lipoferum, Enterobacter* sp., *Klebsiella variicola, Kluyvera intermedia, Kosakonia pseudosacchari, Kosalknia sacchari, Microbacterium murale, Rahnella aquatlis*, and combinations thereof.

In some aspects, the one or more isolated bacteria is from the genus *Klebsiella*. In some aspects, the one or more isolated bacteria is a *Klebsiella variicola*. In some aspects, the one or more isolated bacteria is a *Klebsiella variicola* 137-1036 strain.

In some aspects, the one or more microbes are selected from species of the following genera: *Pseudomonas, Kosakonia, Bacillus, Azospirillum, Candida, Saccharomyces*, and *Agrobacterium*. In some aspects, the one or more microbes is *Kosakonia sacchari.*

In some aspects, the one or more isolated bacteria is from the genus *Klebsiella* and the one or more microbes is from the genus *Kosakonia.*

In some aspects, the one or more isolated bacteria is *Klebsiella variicola* and the one or more microbes is *Kosakonia sacchari.*

In some aspects, the one or more isolated bacteria is *Klebsiella variicola* 137-1036 strain and the one or more microbes is *Kosakonia sacchari.*

In some aspects, the one or more isolated bacteria is capable of fixing atmospheric nitrogen.

In some aspects, the one or more biofilms comprises two biofilms produced by two different microbes.

In some aspects, the viability of the one or more isolated bacteria exhibit an increase of at least 5% when stored for at least 30 days, as compared to a control composition comprising one or more isolated bacteria and lacking the one or more biofilms. In some aspects, the viability of the one or more isolated bacteria exhibit an increase of at least 25%. In some aspects, the viability of the one or more isolated bacteria exhibit an increase in viability when stored in liquid culture for at least 90 days.

In some aspects, the composition is a solid. In some aspects, the composition is a liquid. In some aspects, the composition is a seed coat applied to plant seed. In some aspects, the composition is a semi-solid. In some aspects, the one or more isolated bacteria are transgenic bacteria. In some aspects, the one or more isolated bacteria are non-intergeneric remodeled bacteria. In some aspects, the non-intergeneric remodeled bacteria are derived from, or comprise, a bacterium selected from Table 1.

In some aspects, the non-intergeneric remodeled bacteria comprises at least one genetic variation introduced into at least one gene, or non-coding polynucleotide, of the nitrogen fixation or assimilation genetic regulatory network, such that the modified bacterium is capable of fixing atmospheric nitrogen in the presence of exogenous nitrogen.

In some aspects, the present disclosure is drawn to a method increasing the viability of a bacterial composition, the method comprising combining: (i) one or more isolated bacteria, and (ii) one or more biofilms produced by one or more microbes; wherein the one or more biofilms are exogenous to the one or more isolated bacteria, and wherein the increase in viability is relative to a control composition comprising one or more isolated bacteria and lacking the one or more biofilms.

In some aspects, the one or more isolated bacteria are selected from species of *Achromobacter, Agrobacterium, Anabaena, Azorhizobiunm, Azospirillum, Azotobacter, Bacillus, Bradyrhizobium, Candida, Clostridium, Enterobacter, Klebsiella, Kluyvera, Kosakonia, Mesorhizobium, Microbacterium, Pseudomonas, Rahnella, Rhizobium, Saccharomyces*, and *Sinorhizobium.*

In some aspects, the one or more isolated bacteria are selected from: *Achromobacter marplatensis, Achromobacter spiritinus, Azospirillum lipoferum, Enterobacter* sp., *Klebsiella variicola, Kluyvera intermedia, Kosakonia pseudosacchari, Kosakonia sacchari, Microbacterium murale, Rahnella aquatilis*, and combinations thereof.

In some aspects, the one or more isolated bacteria is from the genus *Klebsiella*. In some aspects, the one or more isolated bacteria is a *Klebsiella variicola*. In some aspects, the one or more isolated bacteria is a Klebsiella variicola 137-1036 strain.

In some aspects, the one or more microbes are selected from species of the following genera: *Pseudomonas, Kosakonia, Bacillus, Azospirillum, Candida, Saccharomyces*, and *Agrobacterium*. In some aspects, the one or more microbes is *Kosakonia sacchari.*

In some aspects, the one or more isolated bacteria is from the genus *Klebsiella* and the one or more microbes is from the genus *Kosakonia.*

In some aspects, the one or more isolated bacteria is *Klebsiella variicola* and the one or more microbes is *Kosakonia sacchari.*

In some aspects, the one or more isolated bacteria is *Klebsiella variicola* 137-1036 strain and the one or more microbes is *Kosakonia sacchari.*

In some aspects, the one or more isolated bacteria is capable of fixing atmospheric nitrogen.

In some aspects, the one or more biofilms comprises two biofilms produced by two different microbes.

In some aspects, the viability of the one or more isolated bacteria exhibit an increase of at least 5% when stored for at least 30 days, as compared to a control composition comprising one or more isolated bacteria and lacking the one or more biofilms. In some aspects, the viability of the one or more isolated bacteria exhibit an increase of at least 25%. In some aspects, the viability of the one or more isolated bacteria exhibit an increase in viability when stored in liquid culture for at least 90 days.

In some aspects, the composition is a solid. In some aspects, the composition is a liquid. In some aspects, the composition is a seed coat applied to plant seed. In some aspects, the composition is a semi-solid. In some aspects, the one or more isolated bacteria are transgenic bacteria. In some aspects, the one or more isolated bacteria are non-intergeneric remodeled bacteria. In some aspects, the non-intergeneric remodeled bacteria are derived from, or comprise, a bacterium selected from Table 1.

In some aspects, the non-intergeneric remodeled bacteria comprises at least one genetic variation introduced into at least one gene, or non-coding polynucleotide, of the nitrogen fixation or assimilation genetic regulatory network, such that the modified bacterium is capable of fixing atmospheric nitrogen in the presence of exogenous nitrogen.

In some aspects of the present disclosure, the one or more microbes are capable of fixing atmospheric nitrogen. In some aspects, the one or more isolated bacteria produce 1% or more of the fixed nitrogen in a plant exposed thereto. In some aspects, the one or more isolated bacteria are capable of fixing atmospheric nitrogen in the presence of exogenous nitrogen. In some aspects, each member of the one or more isolated bacteria comprises at least one genetic variation introduced into at least one gene, or non-coding polynucleotide, of the nitrogen fixation or assimilation genetic regulatory network. In some aspects, each member of the one or more isolated bacteria comprises an introduced control sequence operably linked to at least one gene of the nitrogen fixation or assimilation genetic regulatory network. In some aspects, each member of the one or more isolated bacteria comprises a heterologous promoter operably linked to at least one gene of the nitrogen fixation or assimilation genetic regulatory network.

In some aspects, each member of the one or more isolated bacteria comprises at least one genetic variation introduced into a member selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, or combinations thereof.

In some aspects, each member of the one or more isolated bacteria comprises at least one genetic variation introduced into at least one gene, or non-coding polynucleotide, of the nitrogen fixation or assimilation genetic regulatory network that results in one or more of; increased expression or activity of NifA or glutaminase; decreased expression or activity of NifL, NtrB, glutamine synthetase, GlnB, GlnK, DraT, AmtB; decreased adenylyl-removing activity of GlnE; or decreased uridylyl-removing activity of GlnD.

In some aspects, each member of the one or more isolated bacteria comprises a mutated nifL gene that comprises a heterologous promoter in said nifL gene. In some aspects, each member of the one or more isolated bacteria comprises a mutated glnE gene that results in a truncated GlnE protein lacking an adenylyl-removing (AR) domain. In some aspects, each member of the one or more isolated bacteria comprises a mutated amtB gene that results in the lack of expression of said amtB gene.

In some aspects, each member of the one or more isolated bacteria comprises at least one of: a mutated nifL gene that comprises a heterologous promoter in said nifL gene; a mutated glnE gene that results in a truncated GlnE protein lacking an adenylyl-removing (AR) domain; a mutated amtB gene that results in the lack of expression of said amtB gene; and combinations thereof.

In some aspects, each member of the one or more isolated bacteria comprises a mutated nifL gene that comprises a heterologous promoter in said nifL gene and a mutated glnE gene that results in a truncated GlnE protein lacking an adenylyl-removing (AR) domain. In some aspects, each member of the one or more isolated bacteria comprises a mutated nifL gene that comprises a heterologous promoter in said nifL gene, a mutated glnE gene that results in a truncated GlnE protein lacking an adenylyl-removing (AR) domain, and a mutated amtB gene that results in the lack of expression of said amtB gene.

In some aspects, each of the one or more isolated bacteria comprises at least one genetic variation introduced into genes involved in a pathway selected from the group consisting of: exopolysaccharide production, endo-polygalaturonase production, trehalose production, and glutamine conversion.

In some aspects, each of the one or more isolated bacteria comprises at least one genetic variation introduced into genes selected from the group consisting of: bcsii, bcsiii, yjbE, fhaB, pehA, otsB, treZ, glsA2, and combinations thereof.

In some aspects, the one or more isolated bacteria comprise bacteria selected from: a bacterium deposited as NCMA 201701002, a bacterium deposited as NCMA 201708004, a bacterium deposited as NCMA 201708003, a bacterium deposited as NCMA 201708002, a bacterium deposited as NCMA 201712001, a bacterium deposited as NCMA 201712002, and combinations thereof.

In some aspects, the one or more isolated bacteria comprise bacteria comprising a nucleic acid sequence that shares at least about 95% sequence identity with a nucleic acid sequence selected from SEQ ID NOs: 177-260 and 296-303. In some aspects, the one or more isolated bacteria comprise bacteria comprising a nucleic acid sequence that shares at least about 99% sequence identity with a nucleic acid sequence selected from SEQ ID NOs: 177-260 and 296-303. In some aspects, the one or more isolated bacteria comprise bacteria comprising a nucleic acid sequence selected from SEQ ID NOs: 177-260 and 296-303.

In some aspects, the viability of the one or more isolated bacteria in the compositions and methods of the disclosure exhibit an increase of at least 5% when stored at 37° C., compared to a control composition comprising the one or more isolated bacteria and lacking the one or more biofilms stored under the same conditions.

In some aspects, the viability of the one or more isolated bacteria in the compositions and methods of the disclosure exhibit an increase of at least 5% when stored at 37° C. for 1 week, compared to a control composition comprising the one or more isolated bacteria and lacking the one or more biofilms stored under the same conditions.

In some aspects, the viability of the one or more isolated bacteria exhibit an increase of at least 5% when stored at 37° C. for 2 weeks, compared to a control composition comprising the one or more isolated bacteria and lacking the one or more biofilms stored under the same conditions.

In some aspects, an increase in viability of the one or more isolated bacteria in the compositions and methods of the disclosure increases the stability of the compositions. In some aspects, the compositions of the present disclosure exhibit increased stability such as increased in-jug stability, increased on seed stability, increased in furrow stability, and/or increased in talc stability.

BRIEF DESCRIPTION OF THE DRAWINGS

FIG. 2A depicts stability of 137-1036 formulation after 1-week storage at 25° C.

FIG. 2B depicts stability of 137-1036 formulation after 1-week storage at 37° C.

FIG. 3A depicts stability of 137-1036 formulation after 2-weeks storage at 25° C.

FIG. 3B depicts stability of 137-1036 formulation after 2-weeks storage at 37° C.

FIG. 4A depicts stability of 137-1034 formulation after 1-week storage at 25° C.

FIG. 4B depicts stability of 137-1034 formulation after 1-week storage at 37° C.

FIG. 5A depicts stability of 137-1034 formulation after 2-weeks storage at 25° C.

FIG. 5B depicts stability of 137-1034 formulation after 2-weeks storage at 37° C.

DETAILED DESCRIPTION OF THE DISCLOSURE

Figure 1A:
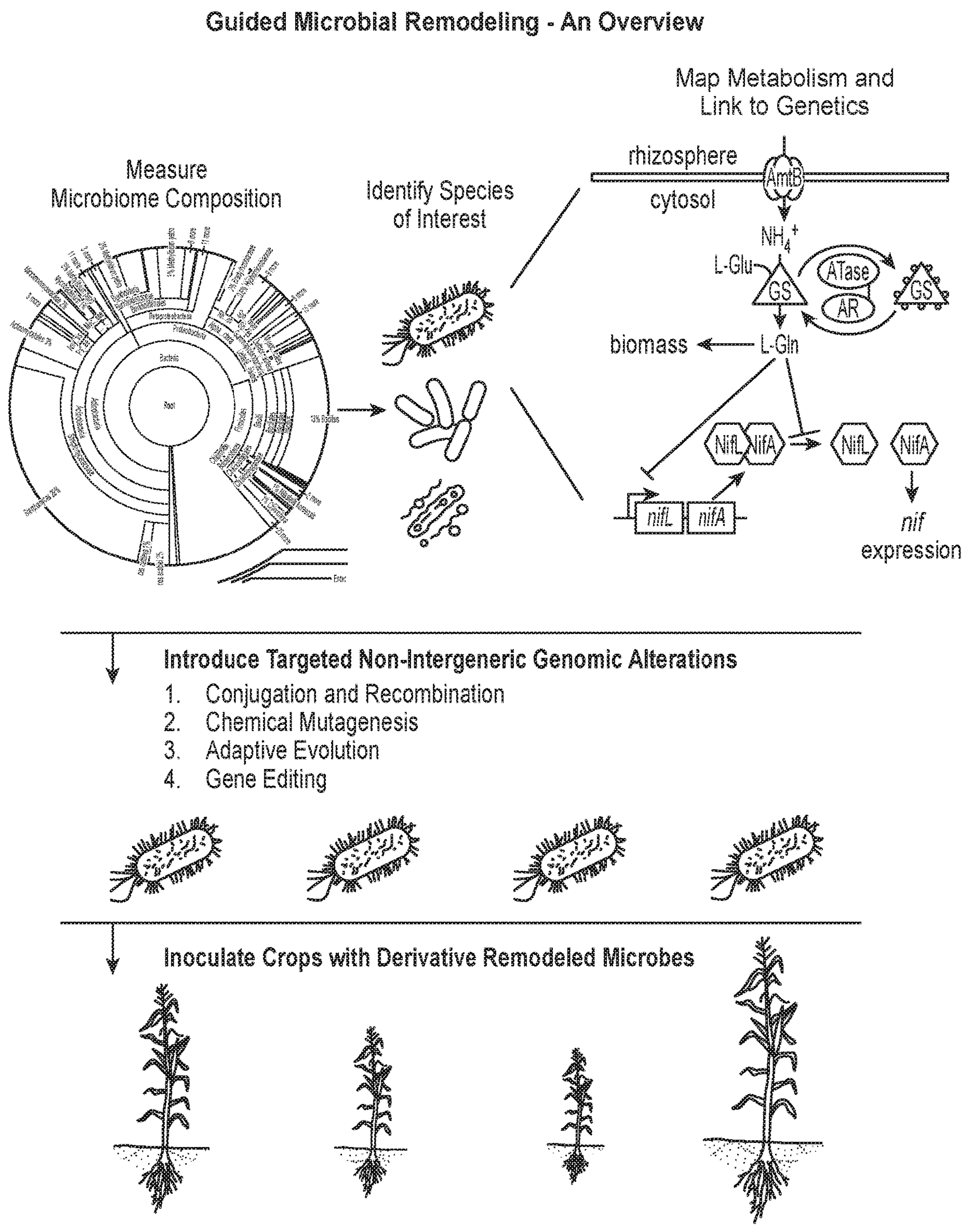
FIG. 1A depicts an overview of the guided microbial remodeling process, in accordance with embodiments.

While various embodiments of the disclosure have been shown and described herein, it will be obvious to those skilled in the art that such embodiments are provided by way of example only. Numerous variations, changes, and substitutions may occur to those skilled in the art without departing from the disclosure. It should be understood that various alternatives to the embodiments of the disclosure described herein may be employed.

Increased fertilizer utilization brings with it environmental concerns and is also likely not possible for many economically stressed regions of the globe. Furthermore, many industry players in the microbial arena are focused on creating intergeneric microbes. However, there is a heavy regulatory burden placed on engineered microbes that are characterized/classified as intergeneric. These intergeneric microbes face not only a higher regulatory burden, which makes widespread adoption and implementation difficult, but they also face a great deal of public perception scrutiny.

Currently, there are no engineered microbes on the market that are non-intergeneric and that are capable of increasing nitrogen fixation in non-leguminous crops. This dearth of such a microbe is a missing element in helping to usher in a truly environmentally friendly and more sustainable $21^{st}$ century agricultural system.

The present disclosure solves the aforementioned problems and provides a non-intergeneric microbe that has been engineered to readily fix nitrogen in crops. These microbes are not characterized/classified as intergeneric microbes and thus will not face the steep regulatory burdens of such. Further, the taught non-intergeneric microbes will serve to help $21^{st}$ century farmers become less dependent upon utilizing ever increasing amounts of exogenous nitrogen fertilizer.

Definitions

The use of the terms "a" and "an" and "the" and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. For example, if the range 10-15 is disclosed, then 11, 12, 13, and 14 are also disclosed. All methods described herein can be performed in any suitable order unless otherwise indicated herein or otherwise clearly contradicted by context. The use of any and all examples, or exemplary language (e.g., "such as") provided herein, is intended merely to better illuminate the disclosure and does not pose a limitation on the scope of the disclosure unless otherwise claimed. No language in the specification should be construed as indicating any non-claimed element as essential to the practice of the disclosure.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner according to base complementarity. The complex may comprise two strands forming a duplex structure, three or more strands forming a multi-stranded complex, a single self-hybridizing strand, or any combination of these. A hybridization reaction may constitute a step in a more extensive process, such as the initiation of PCR, or the enzymatic cleavage of a polynucleotide by an endonuclease. A second sequence that is complementary to a first sequence is referred to as the "complement" of the first sequence. The term "hybridizable" as applied to a polynucleotide refers to the ability of the polynucleotide to form a complex that is stabilized via hydrogen bonding between the bases of the nucleotide residues in a hybridization reaction.

As used herein, "biofilm" or "mature biofilm" refers to associated and/or accumulated and/or aggregated microbial cells, their products (e.g. exopolymeric substances) and inorganic particles adherent to a living or inert surface.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90°/%, and 100% complementary, respectively). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. Sequence identity, such as for the purpose of assessing percent complementarity, may be measured by any suitable alignment algorithm, including but not limited to the Needleman-Wunsch algorithm (see e.g. the EMBOSS Needle aligner available at www.ebi.ac.uk/Tools/psa/emboss_needle/nucleotide.html, optionally with default settings), the BLAST algorithm (see e.g. the BLAST alignment tool available at blast.ncbi.nlm.nih.gov/Blast.cgi, optionally with default settings), or the Smith-Waterman algorithm (see e.g. the EMBOSS Water aligner available at www.ebi.ac.uk/Tools/psa/emboss_water/nucleotide.html, optionally with default settings). Optimal alignment may be assessed using any suitable parameters of a chosen algorithm, including default parameters.

In general, "stringent conditions" for hybridization refer to conditions under which a nucleic acid having complementarity to a target sequence predominantly hybridizes with a target sequence, and substantially does not hybridize to non-target sequences. Stringent conditions are generally sequence-dependent and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y.

As used herein, "expression" refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

As used herein, the term "about" is used synonymously with the term "approximately." Illustratively, the use of the term "about" with regard to an amount indicates that values slightly outside the cited values, e.g., plus or minus 0.1% to 10%.

The term "biologically pure culture" or "substantially pure culture" refers to a culture of a bacterial species described herein containing no other bacterial species in quantities sufficient to interfere with the replication of the culture or be detected by normal bacteriological techniques.

"Plant productivity" refers generally to any aspect of growth or development of a plant that is a reason for which the plant is grown. For food crops, such as grains or vegetables, "plant productivity" can refer to the yield of grain or fruit harvested from a particular crop. As used herein, improved plant productivity refers broadly to improvements in yield of grain, fruit, flowers, or other plant parts harvested for various purposes, improvements in growth of plant parts, including stems, leaves and roots, promotion of plant growth, maintenance of high chlorophyll content in leaves, increasing fruit or seed numbers, increasing fruit or seed unit weight, reducing $NO_2$ emission due to reduced nitrogen fertilizer usage and similar improvements of the growth and development of plants.

Microbes in and around food crops can influence the traits of those crops. Plant traits that may be influenced by microbes include: yield (e.g., grain production, biomass generation, fruit development, flower set); nutrition (e.g., nitrogen, phosphorus, potassium, iron, micronutrient acquisition); abiotic stress management (e.g., drought tolerance, salt tolerance, heat tolerance); and biotic stress management (e.g., pest, weeds, insects, fungi, and bacteria). Strategies for altering crop traits include: increasing key metabolite concentrations; changing temporal dynamics of microbe influence on key metabolites; linking microbial metabolite production/degradation to new environmental cues; reducing negative metabolites; and improving the balance of metabolites or underlying proteins.

As used herein, a "control sequence" refers to an operator, promoter, silencer, or terminator.

As used herein, "in planta" may refer to in the plant, on the plant, or intimately associated with the plant, depending upon context of usage (e.g. endophytic, epiphytic, or rhizospheric associations). The plant may comprise plant parts, tissue, leaves, roots, root hairs, rhizomes, stems, seed, ovules, pollen, flowers, fruit, etc.

In some embodiments, native or endogenous control sequences of genes of the present disclosure are replaced with one or more intrageneric control sequences.

As used herein, "introduced" refers to the introduction by means of modern biotechnology, and not a naturally occurring introduction.

In some embodiments, the bacteria of the present disclosure have been modified such that they are not naturally occurring bacteria.

In some embodiments, the bacteria of the present disclosure are present in the plant in an amount of at least $10^3$ cfu, $10^4$ cfu, $10^1$ cfu, $10^6$ cfu, 107 cfu, $10^1$ cfu, $10^9$ cfu, $10^{10}$ cfu, $10^{11}$ cfu, or $10^{12}$ cfu per gram of fresh or dry weight of the plant. In some embodiments, the bacteria of the present disclosure are present in the plant in an amount of at least about $10^3$ cfu, about $10^4$ cfu, about $10^5$ cfu, about $10^6$ cfu, about $10^7$ cfu, about $10^8$ cfu, about $10^9$ cfu, about $10^{10}$ cfu, about $10^{11}$ cfu, or about $10^{12}$ cfu per gram of fresh or dry weight of the plant. In some embodiments, the bacteria of the present disclosure are present in the plant in an amount of at least $10^3$ to $10^9$, $10^3$ to $10^7$, $10^3$ to $10^5$, $10^5$ to $10^9$, $10^5$ to $10^7$, $10^6$ to $10^1$, $10^6$ to $10^7$ cfu per gram of fresh or dry weight of the plant.

Fertilizers and exogenous nitrogen of the present disclosure may comprise the following nitrogen-containing molecules: ammonium, nitrate, nitrite, ammonia, glutamine, etc. Nitrogen sources of the present disclosure may include anhydrous ammonia, ammonia sulfate, urea, diammonium phosphate, urea-form, monoammonium phosphate, ammonium nitrate, nitrogen solutions, calcium nitrate, potassium nitrate, sodium nitrate, etc.

As used herein, "exogenous nitrogen" refers to non-atmospheric nitrogen readily available in the soil, field, or growth medium that is present under non-nitrogen limiting conditions, including ammonia, ammonium, nitrate, nitrite, urea, uric acid, ammonium acids, etc.

As used herein, "non-nitrogen limiting conditions" refers to non-atmospheric nitrogen available in the soil, field, media at concentrations greater than about 4 mM nitrogen, as disclosed by Kant et al. (2010. J. Exp. Biol. 62(4):1499-1509), which is incorporated herein by reference.

As used herein, an "intergeneric microorganism" is a microorganism that is formed by the deliberate combination of genetic material originally isolated from organisms of different taxonomic genera. An "intergeneric mutant" can be used interchangeably with “intergeneric microorganism”. An exemplary “intergeneric microorganism” includes a microorganism containing a mobile genetic element, which was first identified in a microorganism in a genus different from the recipient microorganism. Further explanation can be found, inter alia, in 40 C.F.R. § 725.3.

In aspects, microbes taught herein are “non-intergeneric,” which means that the microbes are not intergeneric.

As used herein, an “intrageneric microorganism” is a microorganism that is formed by the deliberate combination of genetic material originally isolated from organisms of the same taxonomic genera. An “intrageneric mutant” can be used interchangeably with “intrageneric microorganism”.

As used herein, “introduced genetic material” means genetic material that is added to, and remains as a component of, the genome of the recipient.

As used herein, in the context of non-intergeneric microorganisms, the term “remodeled” is used synonymously with the term “engineered”. Consequently, a “non-intergeneric remodeled microorganism” has a synonymous meaning to “non-intergeneric engineered microorganism,” and will be utilized interchangeably. Further, the disclosure may refer to an “engineered strain” or “engineered derivative” or “engineered non-intergeneric microbe,” these terms are used synonymously with “remodeled strain” or “remodeled derivative” or “remodeled non-intergeneric microbe.”

In some embodiments, the nitrogen fixation and assimilation genetic regulatory network comprises polynucleotides encoding genes and non-coding sequences that direct, modulate, and/or regulate microbial nitrogen fixation and/or assimilation and can comprise polynucleotide sequences of the nif cluster (e.g., nifA, nifB, nifC, . . . nifZ), polynucleotides encoding nitrogen regulatory protein C, polynucleotides encoding nitrogen regulatory protein B, polynucleotide sequences of the gin cluster (e.g. glnA and glnD), draT, and ammonia transporters/permeases. In some cases, the Nif cluster may comprise NifB, NifH, NifD, NifK, NifE, NifN, NifX, hesa, and NifV. In some cases, the Nif cluster may comprise a subset of NifB, NifH, NifD, NifK, NifE, NifN, NifX, hesa, and NifV.

In some embodiments, fertilizer of the present disclosure comprises at least 5%, 6%, 7%, 8%, 9%, 10%, 11%, 12°A, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% nitrogen by weight.

In some embodiments, fertilizer of the present disclosure comprises at least about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 51%, about 52%, about 53%, about 54%, about 55%, about 56%, about 57%, about 58%, about 59%, about 60%, about 61%, about 62%, about 63%, about 64%, about 65%, about 66%, about 67%, about 68%, about 69%, about 70%, about 71%, about 72%, about 73%, about 74%, about 75%, about 76%, about 774%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, or about 99% nitrogen by weight.

In some embodiments, fertilizer of the present disclosure comprises about 5% to 50%, about 5% to 75%, about 10% to 50%, about 10% to 75%, about 15% to 50%, about 15% to 75%, about 20% to 50%, about 20% to 75%, about 25% to 50%, about 25% to 75%, about 30% to 50%, about 30% to 75%, about 35% to 50%, about 35% to 75%, about 40% to 50%, about 40% to 75%, about 45% to 50%, about 45% to 75%, or about 50% to 75% nitrogen by weight.

In some embodiments, the increase of nitrogen fixation and/or the production of 1% or more of the nitrogen in the plant are measured relative to control plants, which have not been exposed to the bacteria of the present disclosure. All increases or decreases in bacteria are measured relative to control bacteria. All increases or decreases in plants are measured relative to control plants.

As used herein, a “constitutive promoter” is a promoter, which is active under most conditions and/or during most development stages. There are several advantages to using constitutive promoters in expression vectors used in biotechnology, such as: high level of production of proteins used to select transgenic cells or organisms; high level of expression of reporter proteins or scorable markers, allowing easy detection and quantification; high level of production of a transcription factor that is part of a regulatory transcription system; production of compounds that requires ubiquitous activity in the organism; and production of compounds that are required during all stages of development. Non-limiting exemplary constitutive promoters include, CaMV 35S promoter, opine promoters, ubiquitin promoter, alcohol dehydrogenase promoter, etc.

As used herein, a “non-constitutive promoter” is a promoter which is active under certain conditions, in certain types of cells, and/or during certain development stages. For example, tissue specific, tissue preferred, cell type specific, cell type preferred, inducible promoters, and promoters under development control are non-constitutive promoters. Examples of promoters under developmental control include promoters that preferentially initiate transcription in certain tissues.

As used herein, “inducible” or “repressible” promoter is a promoter which is under chemical or environmental factors control. Examples of environmental conditions that may affect transcription by inducible promoters include anaerobic conditions, certain chemicals, the presence of light, acidic or basic conditions, etc.

As used herein, a “tissue specific” promoter is a promoter that initiates transcription only in certain tissues. Unlike constitutive expression of genes, tissue-specific expression is the result of several interacting levels of gene regulation. As such, in the art sometimes it is preferable to use promoters from homologous or closely related species to achieve efficient and reliable expression of transgenes in particular tissues. This is one of the main reasons for the large amount of tissue-specific promoters isolated from particular tissues found in both scientific and patent literature.

As used herein, the term “operably linked” refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the disclosure can be operably linked, either directly or indirectly, 5' to the target mRNA, or 3' to the target mRNA, or within the target mRNA, or a first complementary region is 5' and its complement is 3' to the target mRNA.

In aspects, "applying to the plant a plurality of non-intergeneric bacteria," includes any means by which the plant (including plant parts such as a seed, root, stem, tissue, etc.) is made to come into contact (i.e. exposed) with said bacteria at any stage of the plant's life cycle. Consequently, "applying to the plant a plurality of non-intergeneric bacteria," includes any of the following means of exposing the plant (including plant parts such as a seed, root, stem, tissue, etc.) to said bacteria: spraying onto plant, dripping onto plant, applying as a seed coat, applying to a field that will then be planted with seed, applying to a field already planted with seed, applying to a field with adult plants, etc.

As used herein "MRTN" is an acronym for maximum return to nitrogen and is utilized as an experimental treatment in the Examples. MRTN was developed by Iowa State University and information can be found at: cnrc.agron.iastate.edu/ The MRTN is the nitrogen rate where the economic net return to nitrogen application is maximized. The approach to calculating the MRTN is a regional approach for developing corn nitrogen rate guidelines in individual states. The nitrogen rate trial data was evaluated for Illinois, Iowa, Michigan, Minnesota, Ohio, and Wisconsin where an adequate number of research trials were available for corn plantings following soybean and corn plantings following corn. The trials were conducted with spring, side dress, or split preplant/side dress applied nitrogen, and sites were not irrigated except for those that were indicated for irrigated sands in Wisconsin. MRTN was developed by Iowa State University due to apparent differences in methods for determining suggested nitrogen rates required for corn production, misperceptions pertaining to nitrogen rate guidelines, and concerns about application rates. By calculating the MRTN, practitioners can determine the following: (1) the nitrogen rate where the economic net return to nitrogen application is maximized, (2) the economic optimum nitrogen rate, which is the point where the last increment of nitrogen returns a yield increase large enough to pay for the additional nitrogen, (3) the value of corn grain increase attributed to nitrogen application, and the maximum yield, which is the yield where application of more nitrogen does not result in a corn yield increase. Thus, the MRTN calculations provide practitioners with the means to maximize corn crops in different regions while maximizing financial gains from nitrogen applications.

The term mmol is an abbreviation for millimole, which is a thousandth ($10^{-3}$) of a mole, abbreviated herein as mol.

As used herein the terms "microorganism" or "microbe" should be taken broadly. These terms, used interchangeably, include but are not limited to, the two prokaryotic domains, Bacteria and Archaea. The term may also encompass eukaryotic fungi and protists.

The term "microbial consortia" or "microbial consortium" refers to a subset of a microbial community of individual microbial species, or strains of a species, which can be described as carrying out a common function, or can be described as participating in, or leading to, or correlating with, a recognizable parameter, such as a phenotypic trait of interest.

The term "microbial community" means a group of microbes comprising two or more species or strains. Unlike microbial consortia, a microbial community does not have to be carrying out a common function, or does not have to be participating in, or leading to, or correlating with, a recognizable parameter, such as a phenotypic trait of interest.

As used herein, "isolate," "isolated," "isolated microbe," and like terms, are intended to mean that the one or more microorganisms has been separated from at least one of the materials with which it is associated in a particular environment (for example soil, water, plant tissue, etc.). Thus, an "isolated microbe" does not exist in its naturally occurring environment; rather, it is through the various techniques described herein that the microbe has been removed from its natural setting and placed into a non-naturally occurring state of existence. Thus, the isolated strain or isolated microbe may exist as, for example, a biologically pure culture, or as spores (or other forms of the strain). In aspects, the isolated microbe may be in association with an acceptable carrier, which may be an agriculturally acceptable carrier.

In certain aspects of the disclosure, the isolated microbes exist as "isolated and biologically pure cultures." It will be appreciated by one of skill in the art, that an isolated and biologically pure culture of a particular microbe, denotes that said culture is substantially free of other living organisms and contains only the individual microbe in question. The culture can contain varying concentrations of said microbe. The present disclosure notes that isolated and biologically pure microbes often "necessarily differ from less pure or impure materials." See, e.g. In re Bergstrom, 427 F.2d 1394, (CCPA 1970)(discussing purified prostaglandins), see also, In re Bergy, 596 F.2d 952 (CCPA 1979) (discussing purified microbes), see also, Parke Davis & Co. v H. K Mulford & Co., 189 F. 95 (S.D.N.Y. 1911) (Learned Hand discussing purified adrenaline), aff'd in part, rev'd in part, 196 F. 496 (2d Cir. 1912), each of which are incorporated herein by reference. Furthermore, in some aspects, the disclosure provides for certain quantitative measures of the concentration, or purity limitations, that must be found within an isolated and biologically pure microbial culture. The presence of these purity values, in certain embodiments, is a further attribute that distinguishes the presently disclosed microbes from those microbes existing in a natural state. See, e.g., *Merck & Co.* v. *Olin Mathieson Chemical Corp.,* 253 F.2d 156 (4th Cir. 1958) (discussing purity limitations for vitamin B12 produced by microbes), incorporated herein by reference.

As used herein, "individual isolates" should be taken to mean a composition, or culture, comprising a predominance of a single genera, species, or strain, of microorganism, following separation from one or more other microorganisms.

Microbes of the present disclosure may include spores and/or vegetative cells. In some embodiments, microbes of the present disclosure include microbes in a viable but non-culturable (VBNC) state. As used herein, "spore" or "spores" refer to structures produced by bacteria and fungi that are adapted for survival and dispersal. Spores are generally characterized as dormant structures; however, spores are capable of differentiation through the process of germination. Germination is the differentiation of spores into vegetative cells that are capable of metabolic activity, growth, and reproduction. The germination of a single spore results in a single fungal or bacterial vegetative cell. Fungal spores are units of asexual reproduction, and in some cases are necessary structures in fungal life cycles. Bacterial spores are structures for surviving conditions that may ordinarily be nonconducive to the survival or growth of vegetative cells.

As used herein, “microbial composition” refers to a composition comprising one or more microbes of the present disclosure. In some embodiments, a microbial composition is administered to plants (including various plant parts) and/or in agricultural fields.

As used herein, “carrier,” “acceptable carrier,” or “agriculturally acceptable carrier” refers to a diluent, adjuvant, excipient, or vehicle with which the microbe can be administered, which does not detrimentally effect the microbe.

Regulation of Nitrogen Fixation

In some cases, nitrogen fixation pathway may act as a target for genetic engineering and optimization. One trait that may be targeted for regulation by the methods described herein is nitrogen fixation. Nitrogen fertilizer is the largest operational expense on a farm and the biggest driver of higher yields in row crops like corn and wheat. Described herein are microbial products that can deliver renewable forms of nitrogen in non-leguminous crops. While some endophytes have the genetics necessary for fixing nitrogen in pure culture, the fundamental technical challenge is that wild-type endophytes of cereals and grasses stop fixing nitrogen in fertilized fields. The application of chemical fertilizers and residual nitrogen levels in field soils signal the microbe to shut down the biochemical pathway for nitrogen fixation.

Changes to the transcriptional and post-translational levels of components of the nitrogen fixation regulatory network may be beneficial to the development of a microbe capable of fixing and transferring nitrogen to corn in the presence of fertilizer. To that end, described herein is Host-Microbe Evolution (HoME) technology to precisely evolve regulatory networks and elicit novel phenotypes. Also described herein are unique, proprietary libraries of nitrogen-fixing endophytes isolated from corn, paired with extensive omics data surrounding the interaction of microbes and host plant under different environmental conditions like nitrogen stress and excess. In some embodiments, this technology enables precision evolution of the genetic regulatory network of endophytes to produce microbes that actively fix nitrogen even in the presence of fertilizer in the field. Also described herein are evaluations of the technical potential of evolving microbes that colonize corn root tissues and produce nitrogen for fertilized plants and evaluations of the compatibility of endophytes with standard formulation practices and diverse soils to determine feasibility of integrating the microbes into modern nitrogen management strategies.

In order to utilize elemental nitrogen (N) for chemical synthesis, life forms combine nitrogen gas ($N_2$) available in the atmosphere with hydrogen in a process known as nitrogen fixation. Because of the energy-intensive nature of biological nitrogen fixation, diazotrophs (bacteria and archaea that fix atmospheric nitrogen gas) have evolved sophisticated and tight regulation of the nif gene cluster in response to environmental oxygen and available nitrogen. Nif genes encode enzymes involved in nitrogen fixation (such as the nitrogenase complex) and proteins that regulate nitrogen fixation. Shamseldin (2013. Global J. Biotechnol. Biochem. 8(4):84-94) discloses detailed descriptions of nif genes and their products, and is incorporated herein by reference. Described herein are methods of producing a plant with an improved trait comprising isolating bacteria from a first plant, introducing a genetic variation into a gene of the isolated bacteria to increase nitrogen fixation, exposing a second plant to the variant bacteria, isolating bacteria from the second plant having an improved trait relative to the first plant, and repeating the steps with bacteria isolated from the second plant.

In Proteobacteria, regulation of nitrogen fixation centers around the $\sigma_{54}$-dependent enhancer-binding protein NifA, the positive transcriptional regulator of the nif cluster. Intracellular levels of active NifA are controlled by two key factors: transcription of the nifLA operon, and inhibition of NifA activity by protein-protein interaction with NifL. Both of these processes are responsive to intracellular glutamine levels via the PH protein signaling cascade. This cascade is mediated by GlnD, which directly senses glutamine and catalyzes the uridylylation or deuridylylation of two PII regulatory proteins—GlnB and GlnK—in response the absence or presence, respectively, of bound glutamine. Under conditions of nitrogen excess, unmodified GlnB signals the deactivation of the nifLA promoter. However, under conditions of nitrogen limitation, GlnB is post-translationally modified, which inhibits its activity and leads to transcription of the nifLA operon. In this way, nifLA transcription is tightly controlled in response to environmental nitrogen via the PH protein signaling cascade. On the post-translational level of NifA regulation, GlnK inhibits the NifL/NifA interaction in a matter dependent on the overall level of free GlnK within the cell.

NifA is transcribed from the nifLA operon, whose promoter is activated by phosphorylated NtrC, another $\sigma_{54}$-dependent regulator. The phosphorylation state of NtrC is mediated by the histidine kinase NtrB, which interacts with deuridylylated GlnB but not uridylylated GlnB. Under conditions of nitrogen excess, a high intracellular level of glutamine leads to deuridylylation of GlnB, which then interacts with NtrB to deactivate its phosphorylation activity and activate its phosphatase activity, resulting in dephosphorylation of NtrC and the deactivation of the nifLA promoter. However, under conditions of nitrogen limitation, a low level of intracellular glutamine results in uridylylation of GlnB, which inhibits its interaction with NtrB and allows the phosphorylation of NtrC and transcription of the nifLA operon. In this way, nifLA expression is tightly controlled in response to environmental nitrogen via the PII protein signaling cascade. nifA, ntrB, ntrC, and glnB, are all genes that can be mutated in the methods described herein. These processes may also be responsive to intracellular or extracellular levels of ammonia, urea or nitrates.

The activity of NifA is also regulated post-translationally in response to environmental nitrogen, most typically through NifL-mediated inhibition of NifA activity. In general, the interaction of NifL and NifA is influenced by the PII protein signaling cascade via GlnK, although the nature of the interactions between GlnK and NifL/NifA varies significantly between diazotrophs. In *Klebsiella pneumoniae*, both forms of GlnK inhibit the NifL; NifA interaction, and the interaction between GlnK and NifL/NifA is determined by the overall level of free GlnK within the cell. Under nitrogen-excess conditions, deuridylylated GlnK interacts with the ammonium transporter AmtB, which serves to both block ammonium uptake by AmtB and sequester GlnK to the membrane, allowing inhibition of NifA by NifL. On the other hand, in *Azotobacter vinelandii*, interaction with deuridylylated GlnK is required for the NifL/NifA interaction and NifA inhibition, while uridylylation of GlnK inhibits its interaction with NifL. In diazotrophs lacking the nifL gene, there is evidence that NifA activity is inhibited directly by interaction with the deuridylylated forms of both GlnK and GlnB under nitrogen-excess conditions. In some bacteria, the Nif cluster may be regulated by glnR, and further in some cases this may comprise negative regulation. Regardless of the mechanism, post-translational inhibition of NifA is an important regulator of the nif cluster in most known diazotrophs. Additionally, nifL, amtB, glnK, and glnR are genes that can be mutated in the methods described herein.

In addition to regulating the transcription of the nif gene cluster, many diazotrophs have evolved a mechanism for the direct post-translational modification and inhibition of the nitrogenase enzyme itself, known as nitrogenase shutoff. This is mediated by ADP-ribosylation of the Fe protein (NifH) under nitrogen-excess conditions, which disrupts its interaction with the MoFe protein complex (NifDK) and abolishes nitrogenase activity. DraT catalyzes the ADP-ribosylation of the Fe protein and shutoff of nitrogenase, while DraG catalyzes the removal of ADP-ribose and reactivation of nitrogenase. As with nifLA transcription and NifA inhibition, nitrogenase shutoff is also regulated via the PII protein signaling cascade. Under nitrogen-excess conditions, deuridylylated GlnB interacts with and activates DraT, while deuridylylated GlnK interacts with both DraG and AmtB to form a complex, sequestering DraG to the membrane. Under nitrogen-limiting conditions, the uridylylated forms of GlnB and GlnK do not interact with DraT and DraG, respectively, leading to the inactivation of DraT and the diffusion of DraG to the Fe protein, where it removes the ADP-ribose and activates nitrogenase. The methods described herein also contemplate introducing genetic variation into the nifH, nifD, nifK, and draT genes.

Although some endophytes have the ability to fix nitrogen in vitro, often the genetics are silenced in the field by high levels of exogenous chemical fertilizers. One can decouple the sensing of exogenous nitrogen from expression of the nitrogenase enzyme to facilitate field-based nitrogen fixation. Improving the integral of nitrogenase activity across time further serves to augment the production of nitrogen for utilization by the crop. Specific targets for genetic variation to facilitate field-based nitrogen fixation using the methods described herein include one or more genes selected from the group consisting of nifA, nifL, ntrB, ntrC, glnA, glnB, glnK, draT, amtB, glnD, glnE, nifJ, nom, nifD, nifK, nifY, nifE, nifN, nifU, nifS, nifV, nifW, nifZ, nifF, nifB, and nifQ.

An additional target for genetic variation to facilitate field-based nitrogen fixation using the methods described herein is the NifA protein. The NifA protein is typically the activator for expression of nitrogen fixation genes. Increasing the production of NifA (either constitutively or during high ammonia condition) circumvents the native ammonia-sensing pathway. In addition, reducing the production of NifL proteins, a known inhibitor of NifA, also leads to an increased level of freely active NifA. In addition, increasing the transcription level of the nifAL operon (either constitutively or during high ammonia condition) also leads to an overall higher level of NifA proteins. Elevated level of nifAL expression is achieved by altering the promoter itself or by reducing the expression of NtrB (part of ntrB and ntrC signaling cascade that originally would result in the shutoff of nifAL operon during high nitrogen condition). High level of NifA achieved by these or any other methods described herein increases the nitrogen fixation activity of the endophytes.

Another target for genetic variation to facilitate field-based nitrogen fixation using the methods described herein is the GlnD/GlnB/GlnK PII signaling cascade. The intracellular glutamine level is sensed through the GlnD/GlnB/GlnK PII signaling cascade. Active site mutations in GlnD that abolish the uridylyl-removing activity of GlnD disrupt the nitrogen-sensing cascade. In addition, reduction of the GlnB concentration short-circuits the glutamine-sensing cascade. These mutations "trick" the cells into perceiving a nitrogen-limited state, thereby increasing the nitrogen fixation level activity. These processes may also be responsive to intracellular or extracellular levels of ammonia, urea or nitrates.

The amtB protein is also a target for genetic variation to facilitate field-based nitrogen fixation using the methods described herein. Ammonia uptake from the environment can be reduced by decreasing the expression level of amtB protein. Without intracellular ammonia, the endophyte is not able to sense the high level of ammonia, preventing the down-regulation of nitrogen fixation genes. Any ammonia that manages to get into the intracellular compartment is converted into glutamine. Intracellular glutamine level is the major currency of nitrogen sensing. Decreasing the intracellular glutamine level prevents the cells from sensing high ammonium levels in the environment. This effect can be achieved by increasing the expression level of glutaminase, an enzyme that converts glutamine into glutamate. In addition, intracellular glutamine can also be reduced by decreasing glutamine synthase (an enzyme that converts ammonia into glutamine). In diazotrophs, fixed ammonia is quickly assimilated into glutamine and glutamate to be used for cellular processes. Disruptions to ammonia assimilation may enable diversion of fixed nitrogen to be exported from the cell as ammonia. The fixed ammonia is predominantly assimilated into glutamine by glutamine synthetase (GS), encoded by glnA, and subsequently into glutamine by glutamine oxoglutarate aminotransferase (GOGAT). In some examples, glnS encodes a glutamine synthetase. GS is regulated post-translationally by GS adenylyl transferase (GlnE), a bi-functional enzyme encoded by glnE that catalyzes both the adenylylation and de-adenylylation of GS through activity of its adenylyl-transferase (AT) and adenylyl-removing (AR) domains, respectively. Under nitrogen limiting conditions, glnA is expressed, and GlnE's AR domain de-adynylylates GS, allowing it to be active. Under conditions of nitrogen excess, glnA expression is turned off, and GlnE's AT domain is activated allosterically by glutamine, causing the adenylylation and deactivation of GS.

Furthermore, the draT gene may also be a target for genetic variation to facilitate field-based nitrogen fixation using the methods described herein. Once nitrogen fixing enzymes are produced by the cell, nitrogenase shut-off represents another level in which cell downregulates fixation activity in high nitrogen condition. This shut-off could be removed by decreasing the expression level of DraT.

Methods for imparting new microbial phenotypes can be performed at the transcriptional, translational, and post-translational levels. The transcriptional level includes changes at the promoter (such as changing sigma factor affinity or binding sites for transcription factors, including deletion of all or a portion of the promoter) or changing transcription terminators and attenuators. The translational level includes changes at the ribosome binding sites and changing mRNA degradation signals. The post-translational level includes mutating an enzyme's active site and changing protein-protein interactions. These changes can be achieved in a multitude of ways. Reduction of expression level (or complete abolishment) can be achieved by swapping the native ribosome binding site (RBS) or promoter with another with lower strength/efficiency. ATG start sites can be swapped to a GTG, TTG, or CTG start codon, which results in reduction in translational activity of the coding region. Complete abolishment of expression can be done by knocking out (deleting) the coding region of a gene. Frame-shifting the open reading frame (ORF) likely will result in a premature stop codon along the ORF, thereby creating a non-functional truncated product. Insertion of in-frame stop codons will also similarly create a non-functional truncated product. Addition of a degradation tag at the N or C terminal can also be done to reduce the effective concentration of a particular gene.

Conversely, expression level of the genes described herein can be achieved by using a stronger promoter. To ensure high promoter activity during high nitrogen level condition (or any other condition), a transcription profile of the whole genome in a high nitrogen level condition could be obtained and active promoters with a desired transcription level can be chosen from that dataset to replace the weak promoter. Weak start codons can be swapped out with an ATG start codon for better translation initiation efficiency. Weak ribosomal binding sites (RBS) can also be swapped out with a different RBS with higher translation initiation efficiency. In addition, site specific mutagenesis can also be performed to alter the activity of an enzyme.

Increasing the level of nitrogen fixation that occurs in a plant can lead to a reduction in the amount of chemical fertilizer needed for crop production and reduce greenhouse gas emissions (e.g., nitrous oxide).

Regulation of Colonization Potential

In some embodiments, pathways and genes involved in colonization may act as a target for genetic engineering and optimization.

In some cases, exopolysaccharides may be involved in bacterial colonization of plants. In some cases, plant colonizing microbes may produce a biofilm. In some cases, plant colonizing microbes secrete molecules which may assist in adhesion to the plant, or in evading a plant immune response. In some cases, plant colonizing microbes may excrete signaling molecules which alter the plants response to the microbes. In some cases, plant colonizing microbes may secrete molecules which alter the local microenvironment. In some cases, a plant colonizing microbe may alter expression of genes to adapt to a plant said microbe is in proximity to. In some cases, a plant colonizing microbe may detect the presence of a plant in the local environment and may change expression of genes in response.

In some embodiments, to improve colonization, a gene involved in a pathway selected from the group consisting of: exopolysaccharide production, endo-polygalaturonase production, trehalose production, and glutamine conversion may be targeted for genetic engineering and optimization.

In some embodiments, an enzyme or pathway involved in production of exopolysaccharides may be genetically modified to improve colonization. Exemplary genes encoding an exopolysaccharide producing enzyme that may be targeted to improve colonization include, but are not limited to, bcsii, bcsiii, and yjbE.

In some embodiments, an enzyme or pathway involved in production of a filamentous hemagglutinin may be genetically modified to improve colonization. For example, a fhaB gene encoding a filamentous hemagglutinin may be targeted to improve colonization.

In some embodiments, an enzyme or pathway involved in production of an endo-polygalaturonase may be genetically modified to improve colonization. For example, a pehA gene encoding an endo-polygalaturonase precursor may be targeted to improve colonization.

In some embodiments, an enzyme or pathway involved in production of trehalose may be genetically modified to improve colonization. Exemplary genes encoding a trehalose producing enzyme that may be targeted to improve colonization include, but are not limited to, otsB and treZ.

In some embodiments, an enzyme or pathway involved in conversion of glutamine may be genetically modified to improve colonization. For example, the glsA2 gene encodes a glutaminase which converts glutamine into ammonium and glutamate. Upregulating glsA2 improves fitness by increasing the cell's glutamate pool, thereby increasing available N to the cells. Accordingly, in some embodiments, the glsA2 gene may be targeted to improve colonization.

In some embodiments, colonization genes selected from the group consisting of: bcsii, bcsiii, yjbE, fhaB, pehA, otsB, treZ, glsA2, and combinations thereof, may be genetically modified to improve colonization.

Colonization genes that may be targeted to improve the colonization potential are also described in a PCT publication, WO/2019/032926, which is incorporated by reference herein in its entirety.

Generation of Bacterial Populations

Isolation of Bacteria

Microbes useful in methods and compositions disclosed herein can be obtained by extracting microbes from surfaces or tissues of native plants. Microbes can be obtained by grinding seeds to isolate microbes. Microbes can be obtained by planting seeds in diverse soil samples and recovering microbes from tissues. Additionally, microbes can be obtained by inoculating plants with exogenous microbes and determining which microbes appear in plant tissues. Non-limiting examples of plant tissues may include a seed, seedling, leaf, cutting, plant, bulb, or tuber.

A method of obtaining microbes may be through the isolation of bacteria from soils. Bacteria may be collected from various soil types. In some example, the soil can be characterized by traits such as high or low fertility, levels of moisture, levels of minerals, and various cropping practices. For example, the soil may be involved in a crop rotation where different crops are planted in the same soil in successive planting seasons. The sequential growth of different crops on the same soil may prevent disproportionate depletion of certain minerals. The bacteria can be isolated from the plants growing in the selected soils. The seedling plants can be harvested at 2-6 weeks of growth. For example, at least 400 isolates can be collected in a round of harvest. Soil and plant types reveal the plant phenotype as well as the conditions, which allow for the downstream enrichment of certain phenotypes.

Microbes can be isolated from plant tissues to assess microbial traits. The parameters for processing tissue samples may be varied to isolate different types of associative microbes, such as rhizospheric bacteria, epiphytes, or endophytes. The isolates can be cultured in nitrogen-free media to enrich for bacteria that perform nitrogen fixation. Alternatively, microbes can be obtained from global strain banks.

In planta analytics are performed to assess microbial traits. In some embodiments, the plant tissue can be processed for screening by high throughput processing for DNA and RNA. Additionally, non-invasive measurements can be used to assess plant characteristics, such as colonization. Measurements on wild microbes can be obtained on a plant-by-plant basis. Measurements on wild microbes can also be obtained in the field using medium throughput methods. Measurements can be done successively over time. Model plant system can be used including, but not limited to, *Setaria*.

Microbes in a plant system can be screened via transcriptional profiling of a microbe in a plant system. Examples of screening through transcriptional profiling are using methods of quantitative polymerase chain reaction (qPCR), molecular barcodes for transcript detection, Next Generation Sequencing, and microbe tagging with fluorescent markers. Impact factors can be measured to assess colonization in the greenhouse including, but not limited to, microbiome, abiotic factors, soil conditions, oxygen, moisture, temperature, inoculum conditions, and root localization. Nitrogen fixation can be assessed in bacteria by measuring 15N gas/fertilizer (dilution) with IRMS or NanoSIMS as described herein NanoSIMS is high-resolution secondary ion mass spectrometry. The NanoSIMS technique is a way to investigate chemical activity from biological samples. The catalysis of reduction of oxidation reactions that drive the metabolism of microorganisms can be investigated at the cellular, subcellular, molecular and elemental level. NanoSIMS can provide high spatial resolution of greater than 0.1 μm. NanoSIMS can detect the use of isotope tracers such as $^{13}C$, $^{15}N$, and $^{18}O$. Therefore, NanoSIMS can be used to the chemical activity nitrogen in the cell.

Automated greenhouses can be used for planta analytics. Plant metrics in response to microbial exposure include, but are not limited to, biomass, chloroplast analysis, CCD camera, volumetric tomography measurements.

One way of enriching a microbe population is according to genotype. For example, a polymerase chain reaction (PCR) assay with a targeted primer or specific primer. Primers designed for the nifH gene can be used to identity diazotrophs because diazotrophs express the nifH gene in the process of nitrogen fixation. A microbial population can also be enriched via single-cell culture-independent approaches and chemotaxis-guided isolation approaches. Alternatively, targeted isolation of microbes can be performed by culturing the microbes on selection media. Premeditated approaches to enriching microbial populations for desired traits can be guided by bioinformatics data and are described herein.

Enriching for Microbes with Nitrogen Fixation Capabilities Using Bioinformatics

Bioinformatic tools can be used to identify and isolate plant growth promoting rhizobacteria (PGPRs), which are selected based on their ability to perform nitrogen fixation. Microbes with high nitrogen fixing ability can promote favorable traits in plants. Bioinformatic modes of analysis for the identification of PGPRs include, but are not limited to, genomics, metagenomics, targeted isolation, gene sequencing, transcriptome sequencing, and modeling.

Genomics analysis can be used to identify PGPRs and confirm the presence of mutations with methods of Next Generation Sequencing as described herein and microbe version control.

Metagenomics can be used to identify and isolate PGPR using a prediction algorithm for colonization. Metadata can also be used to identify the presence of an engineered strain in environmental and greenhouse samples.

Transcriptomic sequencing can be used to predict genotypes leading to PGPR phenotypes. Additionally, transcriptomic data is used to identify promoters for altering gene expression. Transcriptomic data can be analyzed in conjunction with the Whole Genome Sequence (WGS) to generate models of metabolism and gene regulatory networks.

Domestication of Microbes

Microbes isolated from nature can undergo a domestication process wherein the microbes are converted to a form that is genetically trackable and identifiable. One way to domesticate a microbe is to engineer it with antibiotic resistance. The process of engineering antibiotic resistance can begin by determining the antibiotic sensitivity in the wild type microbial strain. If the bacteria are sensitive to the antibiotic, then the antibiotic can be a good candidate for antibiotic resistance engineering. Subsequently, an antibiotic resistant gene or a counterselectable suicide vector can be incorporated into the genome of a microbe using recombineering methods. A counterselectable suicide vector may consist of a deletion of the gene of interest, a selectable marker, and the counterselectable marker sacB. Counterselection can be used to exchange native microbial DNA sequences with antibiotic resistant genes. A medium throughput method can be used to evaluate multiple microbes simultaneously allowing for parallel domestication. Alternative methods of domestication include the use of homing nucleases to prevent the suicide vector sequences from looping out or from obtaining intervening vector sequences.

DNA vectors can be introduced into bacteria via several methods including electroporation and chemical transformations. A standard library of vectors can be used for transformations. An example of a method of gene editing is CRISPR preceded by Cas9 testing to ensure activity of Cas9 in the microbes.

Non-Transgenic Engineering of Microbes

A microbial population with favorable traits can be obtained via directed evolution. Direct evolution is an approach wherein the process of natural selection is mimicked to evolve proteins or nucleic acids towards a user-defined goal. An example of direct evolution is when random mutations are introduced into a microbial population, the microbes with the most favorable traits are selected, and the growth of the selected microbes is continued. The most favorable traits in growth promoting rhizobacteria (PGPRs) may be in nitrogen fixation. The method of directed evolution may be iterative and adaptive based on the selection process after each iteration.

Plant growth promoting rhizobacteria (PGPRs) with high capability of nitrogen fixation can be generated. The evolution of PGPRs can be carried out via the introduction of genetic variation. Genetic variation can be introduced via polymerase chain reaction mutagenesis, oligonucleotide-directed mutagenesis, saturation mutagenesis, fragment shuffling mutagenesis, homologous recombination, CRISPR/Cas9 systems, chemical mutagenesis, and combinations thereof. These approaches can introduce random mutations into the microbial population. For example, mutants can be generated using synthetic DNA or RNA via oligonucleotide-directed mutagenesis. Mutants can be generated using tools contained on plasmids, which are later cured. Genes of interest can be identified using libraries from other species with improved traits including, but not limited to, improved PGPR properties, improved colonization of cereals, increased oxygen sensitivity, increased nitrogen fixation, and increased ammonia excretion. Intrageneric genes can be designed based on these libraries using software such as Geneious or Platypus design software. Mutations can be designed with the aid of machine learning. Mutations can be designed with the aid of a metabolic model. Automated design of the mutation can be done using a la Platypus and will guide RNAs for Cas-directed mutagenesis.

The intra-generic genes can be transferred into the host microbe. Additionally, reporter systems can also be transferred to the microbe. The reporter systems characterize promoters, determine the transformation success, screen mutants, and act as negative screening tools.

The microbes carrying the mutation can be cultured via serial passaging. A microbial colony contains a single variant of the microbe. Microbial colonies are screened with the aid of an automated colony picker and liquid handler. Mutants with gene duplication and increased copy number express a higher genotype of the desired trait.

Selection of Plant Growth Promoting Microbes Based on Nitrogen Fixation

The microbial colonies can be screened using various assays to assess nitrogen fixation. One way to measure nitrogen fixation is via a single fermentative assay, which measures nitrogen excretion. An alternative method is the acetylene reduction assay (ARA) with in-line sampling over time. ARA can be performed in high throughput plates of microtube arrays. ARA can be performed with live plants and plant tissues. The media formulation and media oxygen concentration can be varied in ARA assays. Another method of screening microbial variants is by using biosensors. The use of NanoSIMS and Raman microspectroscopy can be used to investigate the activity of the microbes. In some cases, bacteria can also be cultured and expanded using methods of fermentation in bioreactors. The bioreactors are designed to improve robustness of bacteria growth and to decrease the sensitivity of bacteria to oxygen. Medium to high TP plate-based microfermentors are used to evaluate oxygen sensitivity, nutritional needs, nitrogen fixation, and nitrogen excretion. The bacteria can also be co-cultured with competitive or beneficial microbes to elucidate cryptic pathways. Flow cytometry can be used to screen for bacteria that produce high levels of nitrogen using chemical, colorimetric, or fluorescent indicators. The bacteria may be cultured in the presence or absence of a nitrogen source. For example, the bacteria may be cultured with glutamine, ammonia, urea or nitrates.

Guided Microbial Remodeling—An Overview

Guided microbial remodeling is a method to systematically identify and improve the role of species within the crop microbiome. In some aspects, and according to a particular methodology of grouping/categorization, the method comprises three steps: 1) selection of candidate species by mapping plant-microbe interactions and predicting regulatory networks linked to a particular phenotype, 2) pragmatic and predictable improvement of microbial phenotypes through intra-species crossing of regulatory networks and gene clusters within a microbe's genome, and 3) screening and selection of new microbial genotypes that produce desired crop phenotypes.

To systematically assess the improvement of strains, a model is created that links colonization dynamics of the microbial community to genetic activity by key species. The model is used to predict genetic targets for non-intergeneric genetic remodeling (i.e. engineering the genetic architecture of the microbe in a non-transgenic fashion). See, FIG. 1 for a graphical representation of an embodiment of the process.

As illustrated in FIG. 1, rational improvement of the crop microbiome may be used to increase soil biodiversity, tune impact of keystone species, and/or alter timing and expression of important metabolic pathways.

To this end, the inventors have developed a platform to identify and improve the role of strains within the crop microbiome. In some aspects, the inventors call this process microbial breeding.

The aforementioned "Guided Microbial Remodeling" process will be further elaborated upon in the Examples, for instance in Example 1, entitled: "Guided Microbial Remodeling—A Platform for the Rational Improvement of Microbial Species for Agriculture."

Serial Passage

Production of bacteria to improve plant traits (e.g., nitrogen fixation) can be achieved through serial passage. The production of these bacteria can be done by selecting plants, which have a particular improved trait that is influenced by the microbial flora, in addition to identifying bacteria and/or compositions that are capable of imparting one or more improved traits to one or more plants. One method of producing a bacteria to improve a plant trait includes the steps of: (a) isolating bacteria from tissue or soil of a first plant; (b) introducing a genetic variation into one or more of the bacteria to produce one or more variant bacteria; (c) exposing a plurality of plants to the variant bacteria; (d) isolating bacteria from tissue or soil of one of the plurality of plants, wherein the plant from which the bacteria is isolated has an improved trait relative to other plants in the plurality of plants; and (e) repeating steps (b) to (d) with bacteria isolated from the plant with an improved trait (step (d)). Steps (b) to (d) can be repeated any number of times (e.g., once, twice, three times, four times, five times, ten times, or more) until the improved trait in a plant reaches a desired level. Further, the plurality of plants can be more than two plants, such as 10 to 20 plants, or 20 or more, 50 or more, 100 or more, 300 or more, 500 or more, or 1000 or more plants.

In addition to obtaining a plant with an improved trait, a bacterial population comprising bacteria comprising one or more genetic variations introduced into one or more genes (e.g., genes regulating nitrogen fixation) is obtained. By repeating the steps described above, a population of bacteria can be obtained that include the most appropriate members of the population that correlate with a plant trait of interest. The bacteria in this population can be identified and their beneficial properties determined, such as by genetic and/or phenotypic analysis. Genetic analysis may occur of isolated bacteria in step (a). Phenotypic and/or genotypic information may be obtained using techniques including: high through-put screening of chemical components of plant origin, sequencing techniques including high throughput sequencing of genetic material, differential display techniques (including DDRT-PCR, and DD-PCR), nucleic acid microarray techniques, RNA-sequencing (Whole Transcriptome Shotgun Sequencing), and qRT-PCR (quantitative real time PCR). Information gained can be used to obtain community profiling information on the identity and activity of bacteria present, such as phylogenetic analysis or microarray-based screening of nucleic acids coding for components of rRNA operons or other taxonomically informative loci. Examples of taxonomically informative loci include 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, coxl gene, nifD gene. Example processes of taxonomic profiling to determine taxa present in a population are described in US20140155283. Bacterial identification may comprise characterizing activity of one or more genes or one or more signaling pathways, such as genes associated with the nitrogen fixation pathway. Synergistic interactions (where two components, by virtue of their combination, increase a desired effect by more than an additive amount) between different bacterial species may also be present in the bacterial populations.

Genetic Variation—Locations and Sources of Genomic Alteration

The genetic variation may be a gene selected from the group consisting of: nifA, nifL, ntrB, ntrC, glnA, glnB, glnK, draT, amtB, glnD, glnE, nifJ, nifH, nifD, nifK, nifY, nifE, nifN, nifU, nifS, nifV, nifW, nifZ, nifM, nifF, nifB, and nifQ. The genetic variation may be a variation in a gene encoding a protein with functionality selected from the group consisting of: glutamine synthetase, glutaminase, glutamine synthetase adenylyltransferase, transcriptional activator, anti-transcriptional activator, pyruvate flavodoxin oxidoreductase, flavodoxin, or NAD+-dinitrogen-reductase aDP-D-ribosyltransferase. The genetic variation may be a mutation that results in one or more of: increased expression or activity of NifA or glutaminase; decreased expression or activity of NifL, NtrB, glutamine synthetase, GlnB, GlnK, DraT, AmtB; decreased adenylyl-removing activity of GlnE; or decreased uridylyl-removing activity of GlnD. Introducing a genetic variation may comprise insertion and/or deletion of one or more nucleotides at a target site, such as 1, 2, 3, 4, 5, 10, 25, 50, 100, 250, 500, or more nucleotides. The genetic variation introduced into one or more bacteria of the methods disclosed herein may be a knock-out mutation (e.g. deletion of a promoter, insertion or deletion to produce a premature stop colon, deletion of an entire gene), or it may be elimination or abolishment of activity of a protein domain (e.g. point mutation affecting an active site, or deletion of a portion of a gene encoding the relevant portion of the protein product), or it may alter or abolish a regulatory sequence of a target gene. One or more regulatory sequences may also be inserted, including heterologous regulatory sequences and regulatory sequences found within a genome of a bacterial species or genus corresponding to the bacteria into which the genetic variation is introduced. Moreover, regulatory sequences may be selected based on the expression level of a gene in a bacterial culture or within a plant tissue. The genetic variation may be a pre-determined genetic variation that is specifically introduced to a target site. The genetic variation may be a random mutation within the target site. The genetic variation may be an insertion or deletion of one or more nucleotides. In some cases, a plurality of different genetic variations (e.g. 2, 3, 4, 5, 10, or more) are introduced into one or more of the isolated bacteria before exposing the bacteria to plants for assessing trait improvement. The plurality of genetic variations can be any of the above types, the same or different types, and in any combination. In some cases, a plurality of different genetic variations are introduced serially, introducing a first genetic variation after a first isolation step, a second genetic variation after a second isolation step, and so forth so as to accumulate a plurality of genetic variations in bacteria imparting progressively improved traits on the associated plants.

Genetic Variation—Methods of Introducing Genomic Alteration

In general, the term “generic variation” refers to any change introduced into a polynucleotide sequence relative to a reference polynucleotide, such as a reference genome or portion thereof, or reference gene or portion thereof. A genetic variation may be referred to as a “mutation,” and a sequence or organism comprising a genetic variation may be referred to as a “genetic variant” or “mutant”. Genetic variations can have any number of effects, such as the increase or decrease of some biological activity, including gene expression, metabolism, and cell signaling. Genetic variations can be specifically introduced to a target site, or introduced randomly. A variety of molecular tools and methods are available for introducing genetic variation. For example, genetic variation can be introduced via polymerase chain reaction mutagenesis, oligonucleotide-directed mutagenesis, saturation mutagenesis, fragment shuffling mutagenesis, homologous recombination, recombineering, lambda red mediated recombination, CRISPR/Cas9 systems, chemical mutagenesis, and combinations thereof. Chemical methods of introducing genetic variation include exposure of DNA to a chemical mutagen, e.g., ethyl methanesulfonate (EMS), methyl methanesulfonate (MMS), N-nitrosourea (EN U), N-methyl-N-nitro-N'-nitrosoguanidine, 4-nitroquinoline N-oxide, diethylsulfate, benzopyrene, cyclophosphamide, bleomycin, triethylmelamine, acrylamide monomer, nitrogen mustard, vincristine, diepoxyalkanes (for example, diepoxybutane), ICR-170, formaldehyde, procarbazine hydrochloride, ethylene oxide, dimethylnitrosamine, 7,12 dimethylbenz(a)anthracene, chlorambucil, hexamethylphosphoramide, bisulfan, and the like. Radiation mutation-inducing agents include ultraviolet radiation, γ-irradiation, X-rays, and fast neutron bombardment. Genetic variation can also be introduced into a nucleic acid using, e.g., trimethylpsoralen with ultraviolet light. Random or targeted insertion of a mobile DNA element, e.g., a transposable element, is another suitable method for generating genetic variation. Genetic variations can be introduced into a nucleic acid during amplification in a cell-free in vitro system, e.g., using a polymerise chain reaction (PCR) technique such as error-prone PCR Genetic variations can be introduced into a nucleic acid in vitro using DNA shuffling techniques (e.g., exon shuffling, domain swapping, and the like). Genetic variations can also be introduced into a nucleic acid as a result of a deficiency in a DNA repair enzyme in a cell, e.g., the presence in a cell of a mutant gene encoding a mutant DNA repair enzyme is expected to generate a high frequency of mutations (i.e., about 1 mutation/100 genes-1 mutation/10,000 genes) in the genome of the cell. Examples of genes encoding DNA repair enzymes include but are not limited to Mut H, Mut S, Mut L, and Mut U, and the homologs thereof in other species (e.g., MSH 1 6, PMS 1 2, MLH 1, GTBP, ERCC-1, and the like). Example descriptions of various methods for introducing genetic variations are provided in e.g., Stemple (2004) Nature 5:1-7; Chiang et al. (1993) PCR Methods Appl 2(3): 210-217; Stemmer (1994) Proc. Natl. Acad. Sci. USA 91:10747-10751; and U.S. Pat. Nos. 6,033,861, and 6,773,900.

Genetic variations introduced into microbes may be classified as transgenic, cisgenic, intragenomic, intrageneric, intergeneric, synthetic, evolved, rearranged, or SNPs.

Genetic variation may be introduced into numerous metabolic pathways within microbes to elicit improvements in the traits described above. Representative pathways include sulfur uptake pathways, glycogen biosynthesis, the glutamine regulation pathway, the molybdenum uptake pathway, the nitrogen fixation pathway, ammonia assimilation, ammonia excretion or secretion, nitrogen uptake, glutamine biosynthesis, annamox, phosphate solubilization, organic acid transport, organic acid production, agglutinins production, reactive oxygen radical scavenging genes, Indole Acetic Acid biosynthesis, trehalose biosynthesis, plant cell wall degrading enzymes or pathways, root attachment genes, exopolysaccharide secretion, glutamate synthase pathway, iron uptake pathways, siderophore pathway, chitinase pathway, ACC deaminase, glutathione biosynthesis, phosphorous signaling genes, quorum quenching pathway, cytochrome pathways, hemoglobin pathway, bacterial hemoglobin-like pathway, small RNA rsmZ, rhizobitoxine biosynthesis, lapA adhesion protein, AHL quorum sensing pathway, phenazine biosynthesis, cyclic lipopeptide biosynthesis, and antibiotic production.

CRISPR/Cas9 (Clustered regularly interspaced short palindromic repeats)/CRISPR-associated (Cas) systems can be used to introduce desired mutations. CRISPR/Cas9 provide bacteria and archaea with adaptive immunity against viruses and plasmids by using CRISPR RNAs (crRNAs) to guide the silencing of invading nucleic acids. The Cas9 protein (or functional equivalent and/or variant thereof, i.e., Cas9-like protein) naturally contains DNA endonuclease activity that depends on the association of the protein with two naturally occurring or synthetic RNA molecules called crRNA and tracrRNA (also called guide RNAs). In some cases, the two molecules are covalently link to form a single molecule (also called a single guide RNA ("sgRNA"). Thus, the Cas9 or Cas9-like protein associates with a DNA-targeting RNA (which term encompasses both the two-molecule guide RNA configuration and the single-molecule guide RNA configuration), which activates the Cas9 or Cas9-like protein and guides the protein to a target nucleic acid sequence. If the Cas9 or Cas9-like protein retains its natural enzymatic function, it will cleave target DNA to create a double-stranded break, which can lead to genome alteration (i.e., editing: deletion, insertion (when a donor polynucleotide is present), replacement, etc.), thereby altering gene expression. Some variants of Cas9 (which variants are encompassed by the term Cas9-like) have been altered such that they have a decreased DNA cleaving activity (in some cases, they cleave a single strand instead of both strands of the target DNA, while in other cases, they have severely reduced to no DNA cleavage activity). Further exemplary descriptions of CRISPR systems for introducing genetic variation can be found in, e.g. U.S. Pat. No. 8,795,965.

As a cyclic amplification technique, polymerase chain reaction (PCR) mutagenesis uses mutagenic primers to introduce desired mutations. PCR is performed by cycles of denaturation, annealing, and extension. After amplification by PCR, selection of mutated DNA and removal of parental plasmid DNA can be accomplished by: 1) replacement of dCTP by hydroxymethylated-dCTP during PCR, followed by digestion with restriction enzymes to remove non-hydroxymethylated parent DNA only; 2) simultaneous mutagenesis of both an antibiotic resistance gene and the studied gene changing the plasmid to a different antibiotic resistance, the new antibiotic resistance facilitating the selection of the desired mutation thereafter; 3) after introducing a desired mutation, digestion of the parent methylated template DNA by restriction enzyme Dpnl which cleaves only methylated DNA, by which the mutagenized unmethylated chains are recovered; or 4) circularization of the mutated PCR products in an additional ligation reaction to increase the transformation efficiency of mutated DNA. Further description of exemplary methods can be found in e.g. U.S. Pat. Nos. 7,132,265, 6,713,285, 6,673,610, 6,391,548, 5,789,166, 5,780,270, 5,354,670, 5,071,743, and US20100267147.

Oligonucleotide-directed mutagenesis, also called site-directed mutagenesis, typically utilizes a synthetic DNA primer. This synthetic primer contains the desired mutation and is complementary to the template DNA around the mutation site so that it can hybridize with the DNA in the gene of interest. The mutation may be a single base change (a point mutation), multiple base changes, deletion, or insertion, or a combination of these. The single-strand primer is then extended using a DNA polymerase, which copies the rest of the gene. The gene thus copied contains the mutated site, and may then be introduced into a host cell as a vector and cloned. Finally, mutants can be selected by DNA sequencing to check that they contain the desired mutation.

Genetic variations can be introduced using error-prone PCR In this technique, the gene of interest is amplified using a DNA polymerase under conditions that are deficient in the fidelity of replication of sequence. The result is that the amplification products contain at least one error in the sequence. When a gene is amplified and the resulting product(s) of the reaction contain one or more alterations in sequence when compared to the template molecule, the resulting products are mutagenized as compared to the template. Another means of introducing random mutations is exposing cells to a chemical mutagen, such as nitrosoguanidine or ethyl methanesulfonate (Nestmann, Mutat Res 1975 June; 28(3):323-30), and the vector containing the gene is then isolated from the host.

Saturation mutagenesis is another form of random mutagenesis, in which one tries to generate all or nearly all possible mutations at a specific site, or narrow region of a gene. In a general sense, saturation mutagenesis is comprised of mutagenizing a complete set of mutagenic cassettes (wherein each cassette is, for example, 1-500 bases in length) in defined polynucleotide sequence to be mutagenized (wherein the sequence to be mutagenized is, for example, from 15 to 100,000 bases in length). Therefore, a group of mutations (e.g. ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons, and groupings of particular nucleotide cassettes.

Fragment shuffling mutagenesis, also called DNA shuffling, is a way to rapidly propagate beneficial mutations. In an example of a shuffling process, DNAse is used to fragment a set of parent genes into pieces of e.g. about 50-100 bp in length. This is then followed by a polymerise chain reaction (PCR) without primers—DNA fragments with sufficient overlapping homologous sequence will anneal to each other and are then be extended by DNA polymerase. Several rounds of this PCR extension are allowed to occur, after some of the DNA molecules reach the size of the parental genes. These genes can then be amplified with another PCR, this time with the addition of primers that are designed to complement the ends of the strands. The primers may have additional sequences added to their 5' ends, such as sequences for restriction enzyme recognition sites needed for ligation into a cloning vector. Further examples of shuffling techniques are provided in US20050266541.

Homologous recombination mutagenesis involves recombination between an exogenous DNA fragment and the targeted polynucleotide sequence. After a double-stranded break occurs, sections of DNA around the 5' ends of the break are cut away in a process called resection. In the strand invasion step that follows, an overhanging 3' end of the broken DNA molecule then "invades" a similar or identical DNA molecule that is not broken. The method can be used to delete a gene, remove exons, add a gene, and introduce point mutations. Homologous recombination mutagenesis can be permanent or conditional. Typically, a recombination template is also provided. A recombination template may be a component of another vector, contained in a separate vector, or provided as a separate polynucleotide. In some embodiments, a recombination template is designed to serve as a template in homologous recombination, such as within or near a target sequence nicked or cleaved by a site-specific nuclease. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. Non-limiting examples of site-directed nucleases useful in methods of homologous recombination include zinc finger nucleases, CRISPR nucleases, TALE nucleases, and meganuclease. For a further description of the use of such nucleases, see e.g. U.S. Pat. No. 8,795,965 and US20140301990.

Mutagens that create primarily point mutations and short deletions, insertions, transversions, and/or transitions, including chemical mutagens or radiation, may be used to create genetic variations. Mutagens include, but are not limited to, ethyl methanesulfonate, methylmethane sulfonate, N-ethyl-N-nitrosurea, triethylmelamine, N-methyl-N-nitrosourea, procarbazine, chlorambucil, cyclophosphamide, diethyl sulfate, acrylamide monomer, melphalan, nitrogen mustard, vincristine, dimethylnitrosamine, N-methyl-N'-nitro-Nitrosoguanidine, nitrosoguanidine, 2-aminopurine, 7,12 dimethyl-benz(a)anthracene, ethylene oxide, hexamethylphosphoramide, bisulfan, diepoxyalkanes (diepoxyoctane, diepoxybutane, and the like), 2-methoxy-6-chloro-9[3-(ethyl-2-chloro-ethyl)amino-propylamino]acridine dihydrochloride and formaldehyde.

Introducing genetic variation may be an incomplete process, such that some bacteria in a treated population of bacteria carry a desired mutation while others do not. In some cases, it is desirable to apply a selection pressure so as to enrich for bacteria carrying a desired genetic variation. Traditionally, selection for successful genetic variants involved selection for or against some functionality imparted or abolished by the genetic variation, such as in the case of inserting antibiotic resistance gene or abolishing a metabolic activity capable of converting a non-lethal compound into a lethal metabolite. It is also possible to apply a selection pressure based on a polynucleotide sequence itself, such that only a desired genetic variation need be introduced (e.g. without also requiring a selectable marker). In this case, the selection pressure can comprise cleaving genomes lacking the genetic variation introduced to a target site, such that selection is effectively directed against the reference sequence into which the genetic variation is sought to be introduced. Typically, cleavage occurs within 100 nucleotides of the target site (e.g. within 75, 50, 25, 10, or fewer nucleotides from the target site, including cleavage at or within the target site). Cleaving may be directed by a site-specific nuclease selected from the group consisting of a Zinc Finger nuclease, a CRISPR nuclease, a TALE nuclease (TALEN), or a meganuclease. Such a process is similar to processes for enhancing homologous recombination at a target site, except that no template for homologous recombination is provided. As a result, bacteria lacking the desired genetic variation are more likely to undergo cleavage that, left unrepaired, results in cell death. Bacteria surviving selection may then be isolated for use in exposing to plants for assessing conferral of an improved trait.

A CRISPR nuclease may be used as the site-specific nuclease to direct cleavage to a target site. An improved selection of mutated microbes can be obtained by using Cas9 to kill non-mutated cells. Plants are then inoculated with the mutated microbes to re-confirm symbiosis and create evolutionary pressure to select for efficient symbionts. Microbes can then be re-isolated from plant tissues. CRISPR nuclease systems employed for selection against non-variants can employ similar elements to those described above with respect to introducing genetic variation, except that no template for homologous recombination is provided. Cleavage directed to the target site thus enhances death of affected cells.

Other options for specifically inducing cleavage at a target site are available, such as zinc finger nucleases, TALE nuclease (TALEN) systems, and meganuclease. Zinc-finger nucleases (ZFNs) are artificial DNA endonucleases generated by fusing a zinc finger DNA binding domain to a DNA cleavage domain. ZFNs can be engineered to target desired DNA sequences and this enables zinc-finger nucleases to cleave unique target sequences. When introduced into a cell, ZFNs can be used to edit target DNA in the cell (e.g., the cell's genome) by inducing double stranded breaks. Transcription activator-like effector nucleases (TALENs) are artificial DNA endonucleases generated by fusing a TAL (Transcription activator-like) effector DNA binding domain to a DNA cleavage domain. TALENS can be quickly engineered to bind practically any desired DNA sequence and when introduced into a cell, TALENs can be used to edit target DNA in the cell (e.g., the cell's genome) by inducing double strand breaks. Meganucleases (homing endonuclease) are endodeoxyribonucleases characterized by a large recognition site (double-stranded DNA sequences of 12 to 40 base pairs. Meganucleases can be used to replace, eliminate or modify sequences in a highly targeted way. By modifying their recognition sequence through protein engineering, the targeted sequence can be changed. Meganucleases can be used to modify all genome types, whether bacterial, plant or animal and are commonly grouped into four families: the LAGLIDADG family (SEQ ID NO: 1), the GIY-YIG family, the His-Cyst box family and the HNH family. Exemplary homing endonucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII.

Genetic Variation—Methods of Identification

The microbes of the present disclosure may be identified by one or more genetic modifications or alterations, which have been introduced into said microbe. One method by which said genetic modification or alteration can be identified is via reference to a SEQ ID NO that contains a portion of the microbe's genomic sequence that is sufficient to identify the genetic modification or alteration.

Further, in the case of microbes that have not had a genetic modification or alteration (e.g. a wild type, WT) introduced into their genomes, the disclosure can utilize 16S nucleic acid sequences to identify said microbes. A 16S nucleic acid sequence is an example of a "molecular marker" or "genetic marker," which refers to an indicator that is used in methods for visualizing differences in characteristics of nucleic acid sequences. Examples of other such indicators are restriction fragment length polymorphism (RFLP) markers, amplified fragment length polymorphism (AFLP) markers, single nucleotide polymorphisms (SNPs), insertion mutations, microsatellite markers (SSRs), sequence-characterized amplified regions (SCARs), cleaved amplified polymorphic sequence (CAPS) markers or isozyme markers or combinations of the markers described herein which defines a specific genetic and chromosomal location. Markers further include polynucleotide sequences encoding 16S or 18S rRNA, and internal transcribed spacer (ITS) sequences, which are sequences found between small-subunit and large-subunit rRNA genes that have proven to be especially useful in elucidating relationships or distinctions when compared against one another. Furthermore, the disclosure utilizes unique sequences found in genes of interest (e.g. nifH, D, K, L, A, glnE, amtB, etc.) to identify microbes disclosed herein.

The primary structure of major rRNA subunit 16S comprise a particular combination of conserved, variable, and hypervariable regions that evolve at different rates and enable the resolution of both very ancient lineages such as domains, and more modern lineages such as genera. The secondary structure of the 16S subunit include approximately 50 helices which result in base pairing of about 67% of the residues. These highly conserved secondary structural features are of great functional importance and can be used to ensure positional homology in multiple sequence alignments and phylogenetic analysis. Over the previous few decades, the 16S rRNA gene has become the most sequenced taxonomic marker and is the cornerstone for the current systematic classification of bacteria and archaea (Yarza et al. 2014. *Nature Rev. Micro.* 12:635 45).

Thus, in certain aspects, the disclosure provides for a sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any sequence in Tables 23, 24, 25, and 26.

Thus, in certain aspects, the disclosure provides for a microbe that comprises a sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 62-303. These sequences and their associated descriptions can be found in Tables 25 and 26.

In some aspects, the disclosure provides for a microbe that comprises a 16S nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 85, 96, 111, 121, 122, 123, 124, 136, 149, 157, 167, 261, 262, 269, 277-283. These sequences and their associated descriptions can be found in Table 26.

In some aspects, the disclosure provides for a microbe that comprises a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 86-95, 97-110, 112-120, 125-135, 137-148, 150-156, 158-166, 168-176, 263-268, 270-274, 275, 276, 284-295. These sequences and their associated descriptions can be found in Table 26.

In some aspects, the disclosure provides for a microbe that comprises a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 94%, 91%, 92%, 93%, 94%, 95%, 96%, 97%, 98%, 99%, or 100% sequence identity to SEQ ID NOs: 177-260, 296-303. These sequences and their associated descriptions can be found in Table 26.

In some aspects, the disclosure provides for a microbe that comprises, or primer that comprises, or probe that comprises, or non-native junction sequence that comprises, a nucleic acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 304-424. These sequences are described in Table 27.

In some aspects, the disclosure provides for a microbe that comprises a non-native junction sequence that shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 372-405. These sequences are described in Table 27.

In some aspects, the disclosure provides for a microbe that comprises an amino acid sequence, which shares at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to SEQ ID NOs: 77, 78, 81, 82, or 83. These sequences and their associated descriptions can be found in Table 25.

Genetic Variation—Methods of Detection: Primers, Probes, and Assays

The present disclosure teaches primers, probes, and assays that are useful for detecting the microbes taught herein. In some aspects, the disclosure provides for methods of detecting the WT parental strains. In other aspects, the disclosure provides for methods of detecting the non-intergeneric engineered microbes derived from the WT strains. In aspects, the present disclosure provides methods of identifying non-intergeneric genetic alterations in a microbe.

In aspects, the genomic engineering methods of the present disclosure lead to the creation of non-natural nucleotide "junction" sequences in the derived non-intergeneric microbes. These non-naturally occurring nucleotide junctions can be used as a type of diagnostic that is indicative of the presence of a particular genetic alteration in a microbe taught herein.

The present techniques are able to detect these non-naturally occurring nucleotide junctions via the utilization of specialized quantitative PCR methods, including uniquely designed primers and probes. In some aspects, the probes of the disclosure bind to the non-naturally occurring nucleotide junction sequences. In some aspects, traditional PCR is utilized. In other aspects, real-time PCR is utilized. In some aspects, quantitative PCR (qPCR) is utilized.

Thus, the disclosure can cover the utilization of two common methods for the detection of PCR products in real-time: (1) non-specific fluorescent dyes that intercalate with any double-stranded DNA, and (2) sequence-specific DNA probes consisting of oligonucleotides that are labelled with a fluorescent reporter which permits detection only after hybridization of the probe with its complementary sequence. In some aspects, only the non-naturally occurring nucleotide junction will be amplified via the taught primers, and consequently can be detected either via a non-specific dye, or via the utilization of a specific hybridization probe. In other aspects, the primers of the disclosure are chosen such that the primers flank either side of a junction sequence, such that if an amplification reaction occurs, then said junction sequence is present.

Aspects of the disclosure involve non-naturally occurring nucleotide junction sequence molecules per se, along with other nucleotide molecules that are capable of binding to said non-naturally occurring nucleotide junction sequences under mild to stringent hybridization conditions. In some aspects, the nucleotide molecules that are capable of binding to said non-naturally occurring nucleotide junction sequences under mild to stringent hybridization conditions are termed "nucleotide probes."

In aspects, genomic DNA can be extracted from samples and used to quantify the presence of microbes of the disclosure by using qPCR. The primers utilized in the qPCR reaction can be primers designed by Primer Blast (www.ncbi.nlm.nih.gov/tools/primer-blast/) to amplify unique regions of the wild-type genome or unique regions of the engineered non-intergeneric mutant strains. The qPCR reaction can be carried out using the SYBR GreenER qPCR SuperMix Universal (Thermo Fisher P/N 11762100) kit, using only forward and reverse amplification primers; alternatively, the Kapa Probe Force kit (Kapa Biosystems P/N KK4301) can be used with amplification primers and a TaqMan probe containing a FAM dye label at the 5' end, an internal ZEN quencher, and a minor groove binder and fluorescent quencher at the 3' end (Integrated DNA Technologies).

Certain primer, probe, and non-native junction sequences are listed in Table 30. qPCR reaction efficiency can be measured using a standard curve generated from a known quantity of gDNA from the target genome. Data can be normalized to genome copies per g fresh weight using the tissue weight and extraction volume.

Quantitative polymerase chain reaction (qPCR) is a method of quantifying, in real time, the amplification of one or more nucleic acid sequences. The real time quantification of the PCR assay permits determination of the quantity of nucleic acids being generated by the PCR amplification steps by comparing the amplifying nucleic acids of interest and an appropriate control nucleic acid sequence, which may act as a calibration standard.

TaqMan probes are often utilized in qPCR assays that require an increased specificity for quantifying target nucleic acid sequences. TaqMan probes comprise an oligonucleotide probe with a fluorophore attached to the 5' end and a quencher attached to the 3' end of the probe. When the TaqMan probes remain as is with the 5' and 3' ends of the probe in close contact with each other, the quencher prevents fluorescent signal transmission from the fluorophore. TaqMan probes are designed to anneal within a nucleic acid region amplified by a specific set of primers. As the Taq polymerase extends the primer and synthesizes the nascent strand, the 5' to 3' exonuclease activity of the Tag polymerase degrades the probe that annealed to the template. This probe degradation releases the fluorophore, thus breaking the close proximity to the quencher and allowing fluorescence of the fluorophore. Fluorescence detected in the qPCR assay is directly proportional to the fluorophore released and the amount of DNA template present in the reaction.

The features of qPCR allow the practitioner to eliminate the labor-intensive post-amplification step of gel electrophoresis preparation, which is generally required for observation of the amplified products of traditional PCR assays. The benefits of qPCR over conventional PCR are considerable, and include increased speed, ease of use, reproducibility, and quantitative ability.

Improvement of Traits

Methods of the present disclosure may be employed to introduce or improve one or more of a variety of desirable traits. Examples of traits that may introduced or improved include: root biomass, root length, height, shoot length, leaf number, water use efficiency, overall biomass, yield, fruit size, grain size, photosynthesis rate, tolerance to drought, heat tolerance, salt tolerance, resistance to nematode stress, resistance to a fungal pathogen, resistance to a bacterial pathogen, resistance to a viral pathogen, level of a metabolite, and proteome expression. The desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the improved traits) grown under identical conditions.

A preferred trait to be introduced or improved is nitrogen fixation, as described herein. In some cases, a plant resulting from the methods described herein exhibits a difference in the trait that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same conditions in the soil. In additional examples, a plant resulting from the methods described herein exhibits a difference in the trait that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under similar conditions in the soil.

The trait to be improved may be assessed under conditions including the application of one or more biotic or abiotic stressors. Examples of stressors include abiotic stresses (such as heat stress, salt stress, drought stress, cold stress, and low nutrient stress) and biotic stresses (such as nematode stress, insect herbivory stress, fungal pathogen stress, bacterial pathogen stress, and viral pathogen stress).

The trait improved by methods and compositions of the present disclosure may be nitrogen fixation, including in a plant not previously capable of nitrogen fixation. In some cases, bacteria isolated according to a method described herein produce 1% or more (e.g. 2%, 3%, 4%, 5%, 6%, 7%, 8%, 9%, 10%, 15%, 20%, or more) of a plant's nitrogen, which may represent an increase in nitrogen fixation capability of at least 2-fold (e.g. 3-fold, 4-fold, 5-fold, 6-fold, 7-fold, 8-fold, 9-fold, 10-fold, 20-fold, 50-fold, 100-fold, 1000-fold, or more) as compared to bacteria isolated from the first plant before introducing any genetic variation. In some cases, the bacteria produce 5% or more of a plant's nitrogen. The desired level of nitrogen fixation may be achieved after repeating the steps of introducing genetic variation, exposure to a plurality of plants, and isolating bacteria from plants with an improved trait one or more times (e.g. 1, 2, 3, 4, 5, 10, 15, 25, or more times). In some cases, enhanced levels of nitrogen fixation are achieved in the presence of fertilizer supplemented with glutamine, ammonia, or other chemical source of nitrogen. Methods for assessing degree of nitrogen fixation are known, examples of which are described herein.

Microbe breeding is a method to systematically identify and improve the role of species within the crop microbiome. The method comprises three steps: 1) selection of candidate species by mapping plant-microbe interactions and predicting regulatory networks linked to a particular phenotype, 2) pragmatic and predictable improvement of microbial phenotypes through intra-species crossing of regulatory networks and gene clusters, and 3) screening and selection of new microbial genotypes that produce desired crop phenotypes. To systematically assess the improvement of strains, a model is created that links colonization dynamics of the microbial community to genetic activity by key species. The model is used to predict genetic targets for breeding and improve the frequency of selecting improvements in microbiome-encoded traits of agronomic relevance.

Measuring Nitrogen Delivered in an Agriculturally Relevant Field Context

In the field, the amount of nitrogen delivered can be determined by the function of colonization multiplied by the activity.

$$\text{Nitrogen delivered} = \int_{Time\ \&\ Space} \text{Colonization} \times \text{Activity}$$

The above equation requires (1) the average colonization per unit of plant tissue, and (2) the activity as either the amount of nitrogen fixed or the amount of ammonia excreted by each microbial cell. To convert to pounds of nitrogen per acre, corn growth physiology is tracked over time, e.g., size of the plant and associated root system throughout the maturity stages.

The pounds of nitrogen delivered to a crop per acre-season can be calculated by the following equation:

$$\text{Nitrogen delivered} = \int \text{Plant Tissue}\ (t) \times \text{Colonization}\ (t) \times \text{Activity}\ (t)\,dt$$

The Plant Tissue(t) is the fresh weight of corn plant tissue over the growing time (t). Values for reasonably making the calculation are described in detail in the publication entitled Roots, Growth and Nutrient Uptake (Mengel. Dept. of Agronomy Pub. #AGRY-95-08 (Rev. May-95. p. 1-8.).

The Colonization (t) is the amount of the microbes of interest found within the plant tissue, per gram fresh weight of plant tissue, at any particular time, t, during the growing season. In the instance of only a single time point available, the single time point is normalized as the peak colonization rate over the season, and the colonization rate of the remaining time points are adjusted accordingly.

Activity (t) is the rate of which N is fixed by the microbes of interest per unit time, at any particular time, t, during the growing season. In the embodiments disclosed herein, this activity rate is approximated by in vitro acetylene reduction assay (ARA) in ARA media in the presence of 5 mM glutamine or Ammonium excretion assay in ARA media in the presence of 5 mM ammonium ions.

The Nitrogen delivered amount is then calculated by numerically integrating the above function. In cases where the values of the variables described above are discretely measured at set time points, the values in between those time points are approximated by performing linear interpolation.

Nitrogen Fixation

Described herein are methods of increasing nitrogen fixation in a plant, comprising exposing the plant to bacteria comprising one or more genetic variations introduced into one or more genes regulating nitrogen fixation, wherein the bacteria produce 1% or more of nitrogen in the plant (e.g. 2%, 5%, 10%, or more), which may represent a nitrogen-fixation capability of at least 2-fold as compared to the plant in the absence of the bacteria. The bacteria may produce the nitrogen in the presence of fertilizer supplemented with glutamine, urea, nitrates or ammonia. Genetic variations can be any genetic variation described herein, including examples provided above, in any number and any combination. The genetic variation may be introduced into a gene selected from the group consisting of nifA, nifL, ntrB, ntrC, glutamine synthetase, glnA, glnB, glnK, draT, amtB, glutaminase, glnD, glnE, nifJ, nifH, nifD, nifK, nifY, nifE, nifN, nifU, nifS, nifV, nifW, nifZ, nifM, nifF, nifB, and nifQ. The genetic variation may be a mutation that results in one or more of: increased expression or activity of nifA or glutaminase; decreased expression or activity of nifL, ntrB, glutamine synthetase, glnB, glnK, draT, amtB; decreased adenylyl-removing activity of GlnE; or decreased uridylyl-removing activity of GlnD. The genetic variation introduced into one or more bacteria of the methods disclosed herein may be a knock-out mutation or it may abolish a regulatory sequence of a target gene, or it may comprise insertion of a heterologous regulatory sequence, for example, insertion of a regulatory sequence found within the genome of the same bacterial species or genus. The regulatory sequence can be chosen based on the expression level of a gene in a bacterial culture or within plant tissue. The genetic variation may be produced by chemical mutagenesis. The plants grown in step (c) may be exposed to biotic or abiotic stressors.

The amount of nitrogen fixation that occurs in the plants described herein may be measured in several ways, for example by an acetylene-reduction (AR) assay. An acetylene-reduction assay can be performed in vitro or in vivo. Evidence that a particular bacterium is providing fixed nitrogen to a plant can include: 1) total plant N significantly increases upon inoculation, preferably with a concomitant increase in N concentration in the plant; 2) nitrogen deficiency symptoms are relieved under N-limiting conditions upon inoculation (which should include an increase in dry matter); 3) $N_2$ fixation is documented through the use of an $^{15}N$ approach (which can be isotope dilution experiments, $^{15}N_2$ reduction assays, or $^{15}N$ natural abundance assays); 4) fixed N is incorporated into a plant protein or metabolite; and 5) all of these effects are not be seen in non-inoculated plants or in plants inoculated with a mutant of the inoculum strain.

The wild-type nitrogen fixation regulatory cascade can be represented as a digital logic circuit where the inputs $O_2$ and $NH_4^+$ pass through a NOR gate, the output of which enters an AND gate in addition to ATP. In some embodiments, the methods disclosed herein disrupt the influence of $NH_4^+$ on this circuit, at multiple points in the regulatory cascade, so that microbes can produce nitrogen even in fertilized fields. However, the methods disclosed herein also envision altering the impact of ATP or $O_2$ on the circuitry, or replacing the circuitry with other regulatory cascades in the cell, or altering genetic circuits other than nitrogen fixation. Gene clusters can be re-engineered to generate functional products under the control of a heterologous regulatory system. By eliminating native regulatory elements outside of, and within, coding sequences of gene clusters, and replacing them with alternative regulatory systems, the functional products of complex genetic operons and other gene clusters can be controlled and/or moved to heterologous cells, including cells of different species other than the species from which the native genes were derived. Once re-engineered, the synthetic gene clusters can be controlled by genetic circuits or other inducible regulatory systems, thereby controlling the products' expression as desired. The expression cassettes can be designed to act as logic gates, pulse generators, oscillators, switches, or memory devices. The controlling expression cassette can be linked to a promoter such that the expression cassette functions as an environmental sensor, such as an oxygen, temperature, touch, osmotic stress, membrane stress, or redox sensor.

As an example, the nifL, nifA, nifT, and nifX genes can be eliminated from the nif gene cluster. Synthetic genes can be designed by codon randomizing the DNA encoding each amino acid sequence. Codon selection is performed, specifying that codon usage be as divergent as possible from the codon usage in the native gene. Proposed sequences are scanned for any undesired features, such as restriction enzyme recognition sites, transposon recognition sites, repetitive sequences, sigma 54 and sigma 70 promoters, cryptic ribosome binding sites, and rho independent terminators. Synthetic ribosome binding sites are chosen to match the strength of each corresponding native ribosome binding site, such as by constructing a fluorescent reporter plasmid in which the 150 bp surrounding a gene's start codon (from −60 to +90) is fused to a fluorescent gene. This chimera can be expressed under control of the Ptac promoter, and fluorescence measured via flow cytometry. To generate synthetic ribosome binding sites, a library of reporter plasmids using 150 bp (−60 to +90) of a synthetic expression cassette is generated. Briefly, a synthetic expression cassette can consist of a random DNA spacer, a degenerate sequence encoding an RBS library, and the coding sequence for each synthetic gene. Multiple clones are screened to identify the synthetic ribosome binding site that best matched the native ribosome binding site. Synthetic operons that consist of the same genes as the native operons are thus constructed and tested for functional complementation. A further exemplary description of synthetic operons is provided in US20140329326.

Bacterial Species

Microbes useful in the methods and compositions disclosed herein may be obtained from any source. In some cases, microbes may be bacteria, archaea, protozoa or fungi. The microbes of this disclosure may be nitrogen fixing microbes, for example a nitrogen fixing bacteria, nitrogen fixing archaea, nitrogen fixing fungi, nitrogen fixing yeast, or nitrogen fixing protozoa. Microbes useful in the methods and compositions disclosed herein may be spore-forming microbes, for example spore forming bacteria. In some cases, bacteria useful in the methods and compositions disclosed herein may be Gram positive bacteria or Gram negative bacteria. In some cases, the bacteria may be an endospore forming bacteria of the Firmicute phylum. In some cases, the bacteria may be a diazotroph. In some cases, the bacteria may not be a diazotroph.

The methods and compositions of this disclosure may be used with an archaea, such as, for example, *Methanothermobacter thermoautotrophicus.*

In some cases, bacteria which may be useful include, but are not limited to, *Agrobacterium radiobacter, Bacillus acidocaldarius, Bacillus acidoterrestris, Bacillus agri, Bacillus aizawai, Bacillus albolactis, Bacillus alcalophilus, Bacillus alvei, Bacillus aminoglucosidicus, Bacillus aminovorans, Bacillus amylolyticus* (also known as *Paenibacillus amylolyticus*) *Bacillus amyloliquefaciens, Bacillus aneurinolyticus, Bacillus atrophaeus, Bacillus azotoformans, Bacillus badius, Bacillus cereus* (synonyms: *Bacillus endorhythmos, Bacillus medusa*), *Bacillus chitinosporis, Bacillus circulars, Bacillus coagulans, Bacillus endoparasiticus Bacillus fastidiosus, Bacillus firmus, Bacillus kurstaki, Bacillus lacticola, Bacillus lactimorbus, Bacillus lactis, Bacillus laterosporus* (also known as *Brevibacillus laterosporus*), *Bacillus lautus, Bacillus lentimorhus, Bacillus lentos, Bacillus licheniformis, Bacillus maroccanus, Bacillus megaterium, Bacillus metiens, Bacillus mycoides, Bacillus natto, Bacillus nematocida, Bacillus nigrifrcans, Bacillus nigrum, Bacillus pantothenticus, Bacillus popillae, Bacillus psychrosaccharolyticus, Bacillus pumilus, Bacillus siamensis, Bacillus smithii, Bacillus sphaericus, Bacillus suhtilis, Bacillus thuringiensis, Bacillus uniflagellatus, Bradyrhizobium japonicum, Brevibacillus brevis Brevibacillus laterosporus* (formerly *Bacillus laterosporus*), *Chromobacterium subtsugae, Delhia acidowirans, Lactobacillus acidophilus, Lysobacter antibioticus, Lysobacter enzymogenes, Paenibacillus alvei, Paenibacillus polymyxa, Paenibacillus popilliae* (formerly *Bacillus popilliae*), *Pantoea agglomerans, Pasteuria penetrans* (formerly *Bacillus penetrans*), *Pasteuria usgae, Pectobacterium carotovorum* (formerly *Erwinia carotovora*), *Pseudomonas aeruginosa, Pseudomonas aureofaciens, Pseudomonas cepacia* (formerly known as *Burkholderia cepacia*), *Pseudomonas chlororaphis, Pseudomonas fluorescens, Pseudomonas proradix, Pseudomonas putida, Pseudomonas syringae, Serratia entomophila, Serratia marcescens, Streptomyces colombiensis, Streptomyces galbus, Streptomyces goshikiensis, Streptomyces griseoviridis, Streptomyces lavendulae, Streptomyces prasinus, Streptomyces saraceticus, Streptomyces venezuelae, Xanthontonas campestris, Xenorhabdus luminescens, Xenorhabdus nematophila, Rhodococcus globerulus* AQ719 (NRRL Accession No. B-21663), *Bacillus* sp. AQ175 (ATCC Accession No. 55608), *Bacillus* sp. AQ 177 (ATCC Accession No. 55609), *Bacillus* sp. AQ178 (ATCC Accession No. 53522), and *Streptomyces* sp. strain NRRL Accession No. B-30145. In some cases the bacterium may be *Azotobacter chroococcum, Methanosarcina barkeri, Klesiella pneumoniae, Azotobacter vinelandii, Azospirilltm brasilense, Rhodobacter spharoides, Rhodobacter capsulatus, Rhodobcter paltstris, Rhodosporillum rubrum, Rhizobium leguminosarum* or *Rhizobium etli.*

In some cases, the bacterium may be a species of *Clostridium*, for example *Clostridium pasteurianum, Clostridium heijerinckii, Clostridium petfringens, Clostridium tetani, Clostridium acetobutylicum.*

In some cases, bacteria used with the methods and compositions of the present disclosure may be cyanobacteria. Examples of cyanobacterial genera include *Anabaena* (for example *Anagaena* sp. PCC7120), *Nostoc* (for example *Nostoc punctiforme*), or *Synechocystis* (for example *Syntechocystis* sp. PCC6803).

In some cases, bacteria used with the methods and compositions of the present disclosure may belong to the phylum Chlorobi, for example *Chlorobium tepidum.*

In some cases, microbes used with the methods and compositions of the present disclosure may comprise a gene homologous to a known NifH gene. Sequences of known NifH genes may be found in, for example, the Zehr lab NifH database, (wwwzehr.pmc.ucsc.edu/nifH_Databa_Public/, Apr. 4, 2014), or the Buckley lab NifH database (www.css-.cornell.edu/faculty/buckley/nifh.htm, and Gaby, John Christian, and Daniel H. Buckley. "A comprehensive aligned nifH gene database. a multipurpose tool for studies of nitrogen-fixing bacteria." *Database* 2014 (2014). bau001.). In some cases, microbes used with the methods and compositions of the present disclosure may comprise a sequence which encodes a polypeptide with at least 60%, 70%, 80%, 85%, 90%, 95%, 96%, 96%, 98%, 99% or more than 99% sequence identity to a sequence from the Zehr lab NifH database, (wwwzehr.pmc.ucsc.edu/nifH_Database-_Public/, Apr. 4, 2014). In some cases, microbes used with the methods and compositions of the present disclosure may comprise a sequence which encodes a polypeptide with at least 60%. 70%, 80%%, 85%, 90%%, 95%, 96%%, 96%, 98%. 99% or more than 99% sequence identity to a sequence from the Buckley lab NifH database, (Gaby, John Christian, and Daniel H. Buckley. "A comprehensive aligned nifH gene database: a multipurpose tool for studies of nitrogen-fixing bacteria." Database 2014 (2014): bau001.).

Microbes useful in the methods and compositions disclosed herein can be obtained by extracting microbes from surfaces or tissues of native plants; grinding seeds to isolate microbes; planting seeds in diverse soil samples and recovering microbes from tissues; or inoculating plants with exogenous microbes and determining which microbes appear in plant tissues. Non-limiting examples of plant tissues include a seed, seedling, leaf, cutting, plant, bulb, tuber, root, and rhizomes. In some cases, bacteria are isolated from a seed. The parameters for processing samples may be varied to isolate different types of associative microbes, such as rhizospheric, epiphytes, or endophytes. Bacteria may also be sourced from a repository, such as environmental strain collections, instead of initially isolating from a first plant. The microbes can be genotyped and phenotyped, via sequencing the genomes of isolated microbes; profiling the composition of communities in planta; characterizing the transcriptomic functionality of communities or isolated microbes; or screening microbial features using selective or phenotypic media (e.g., nitrogen fixation or phosphate solubilization phenotypes). Selected candidate strains or populations can be obtained via sequence data; phenotype data; plant data (e.g., genome, phenotype, and/or yield data); soil data (e.g., pH, N/P/K content, and/or bulk soil biotic communities); or any combination of these.

The bacteria and methods of producing bacteria described herein may apply to bacteria able to self-propagate efficiently on the leaf surface, root surface, or inside plant tissues without inducing a damaging plant defense reaction, or bacteria that are resistant to plant defense responses. The bacteria described herein may be isolated by culturing a plant tissue extract or leaf surface wash in a medium with no added nitrogen. However, the bacteria may be unculturable, that is, not known to be culturable or difficult to culture using standard methods known in the art. The bacteria described herein may be an endophyte or an epiphyte or a bacterium inhabiting the plant rhizosphere (rhizospheric bacteria). The bacteria obtained after repeating the steps of introducing genetic variation, exposure to a plurality of plants, and isolating bacteria from plants with an improved trait one or more times (e.g. 1, 2, 3, 4, 5, 10, 15, 25, or more times) may be endophytic, epiphytic, or rhizospheric. Endophytes are organisms that enter the interior of plants without causing disease symptoms or eliciting the formation of symbiotic structures, and are of agronomic interest because they can enhance plant growth and improve the nutrition of plants (e.g., through nitrogen fixation). The bacteria can be a seed-borne endophyte. Seed-borne endophytes include bacteria associated with or derived from the seed of a grass or plant, such as a seed-borne bacterial endophyte found in mature, dry, undamaged (e.g., no cracks, visible fungal infection, or prematurely germinated) seeds. The seed-borne bacterial endophyte can be associated with or derived from the surface of the seed; alternatively, or in addition, it can be associated with or derived from the interior seed compartment (e.g., of a surface-sterilized seed). In some cases, a seed-borne bacterial endophyte is capable of replicating within the plant tissue, for example, the interior of the seed. Also, in some cases, the seed-borne bacterial endophyte is capable of surviving desiccation.

The bacterial isolated according to methods of the disclosure, or used in methods or compositions of the disclosure, can comprise a plurality of different bacterial taxa in combination. By way of example, the bacteria may include Proteobacteria (such as *Pseudomonas, Enterobacter, Stenotrophomonas, Burkholderia, Rhizobium, Herbaspirillum, Pantoea, Serratia, Rahnella, Azospirillum, Azorhizobium, Azotobacter, Duganella, Delftia, Bradyrhizobiun, Sinorhizobium* and *Halomonas*), Firmicutes (such as *Bacillus, Paenibacillus, Lactobacillus, Mycoplasma*, and *Acetabacterium*),and Actinobacteria (such as *Streptomyces, Rhodacoccus, Microbacterium*, and *Curtobacterium*). The bacteria used in methods and compositions of this disclosure may include nitrogen fixing bacterial consortia of two or more species. In some cases, one or more bacterial species of the bacterial consortia may be capable of fixing nitrogen. In some cases, one or more species of the bacterial consortia may facilitate or enhance the ability of other bacteria to fix nitrogen. The bacteria which fix nitrogen and the bacteria which enhance the ability of other bacteria to fix nitrogen may be the same or different. In some examples, a bacterial strain may be able to fix nitrogen when in combination with a different bacterial strain, or in a certain bacterial consortia, but may be unable to fix nitrogen in a monoculture. Examples of bacterial genera which may be found in a nitrogen fixing bacterial consortia include, but are not limited to, *Herbaspirillum, Azospirillum, Enterobacter*, and *Bacillus.*

Bacteria that can be produced by the methods disclosed herein include *Azotobacter* sp., *Bradyrhizobium* sp., *Klebsiella* sp., and *Sinorhizobium* sp. In some cases, the bacteria may be selected from the group consisting of: *Azotobacter vinelandii, Azospirillum brasilense, Bradyrhizobium japonicum, Klebsiella pneumoniae*, and *Sinorhizobium meliloti*. In some cases, the bacteria may be of the genus *Enterobacter* or *Rahnella*. In some cases, the bacteria may be of the genus *Frankia*, or *Clostridium*. Examples of bacteria of the genus *Clostridium* include, but are not limited to, *Clostridium acetobutilicum, Clostridium pasteurianum, Clostridium beijerinckii, Clostridium perfringens*, and *Clostridium tetani*. In some cases, the bacteria may be of the genus *Paenibacillus*, for example *Paenibacillus azotoftxans, Paenibacillus borealis, Paenibacillus durus, Paenibacillus macerans, Paenibacillus polymyxa, Paenibacillus alvei, Paenibacillus amylolyticus, Paenibacillus campinasensis, Paenibacillus chibensis, Paenibacillus glucanolyticus, Paenibacillus illinoisensis, Paenibacillus larvae* subsp. Larvae, *Paenibacillus larvae* subsp. *Pulvifaciens, Paenibacillus lautus, Paenibacillus macerans, Paenibacillus macquariensis, Paenibacillus macquariensis, Paenibacillus pabuli, Paenibacillus peoriae*, or *Paenibacillus polymyxa.*

In some examples, bacteria isolated according to methods of the disclosure can be a member of one or more of the following taxa: *Achromobacter, Acidithiobacillus, Acidovorax, Acidovoraz, Acinetobacter, Actinoplanes, Adlercreutzia, Aerococcus, Aeromonas, Afipia, Agromyces, Ancylobacter, Arthrobacter, Atopostipes, Azospirillum, Bacillus, Bdellovibrio, Beijerinckia, Bosea, Bradyrhizobium, Brevibacillus, Brevundimonas, Burkholderia, Candidatus Haloredivivus, Caulobacter, Cellulomonas, Cellvibrio, Chryseobacterium, Citrobacter, Clostridium, Coraliomargarita, Corynebacterium, Cupriavidus, Curtobacterium, Curvibacter, Deinococcus, Defia, Desemzia, Devosia, Dokdonella, Dyella, Enhydrobacter, Enterobacter, Enterococcus, Erwinia, Escherichia, Escherichia/Shigella, Exiguobacterium, Ferroglobus, Filimonas, Finegoldia, Flavisolibacter, Flavobacterium, Frigoribacterium, Gluconacetobacter, Hafiria, Halobaculum, Halomonas, Halosimplex, Herbaspirillum, Hyinenobacter, Klebsiella, Kocuria, Kosakonia, Lactobacillus, Leclercia, Lentzea, Luteibacter, Luteimonas, Massilia, Mesorhizobium, Methylobacterium, Microbacterium,*

*Micrococcus, Microvirga, Mycobacterium, Neisseria, Nocardia, Oceanibaculum, Ochrobactrum, Okibacterium, Oligotropha, Oryzihumus, Oxalophagus, Paenibacillus, Pantoea, Pantoea, Pelomonas, Perlucidibaca, Plantibacter, Polynucleobacter, Propionibacterium, Propioniciclava, Pseudoclavihacter, Pseudomonas, Pseudonocardia, Pseudoxanthomonas, Psychrobacter, Rahnella, Ralstonia, Rheinheimera, Rhizobium, Rhodococcus, Rhodopseudomonas, Roseateles, Ruminococcus, Sebaldella, Sediminibacillus, Sediminibacterium, Serratia, Shigella, Shinella, Sinorhizobium, Sinosporangium, Sphingobacterium, Sphingomonas, Sphingopyxis, Sphingosinicella, Staphylococcus,* 25 *Stenotrophomonas, Strenotrophomonas, Streptococcus, Streptomyces, Stygiolobus, Sulfurisphaera, Tatumella, Tepidimonas, Thermomonas, Thiobacillus, Variovorax*, WPS-2 genera *Incertae sedis, Xanthomonas*, and *Zimmermannella.*

In some cases, a bacterial species selected from at least one of the following genera are utilized: *Enterobacter, Klebsiella, Kosakonia*, and *Rahnella*. In some cases, a combination of bacterial species from the following genera are utilized: *Enterobacter, Klebsiella, Kosakonia*, and *Rahnella*. In some cases, the species utilized can be one or more of: *Enterobacter sacchari, Klebsiella variicola, Kosakonia sacchari*, and *Rahnella aquatilis.*

In some cases, a Gram positive microbe may have a Molybdenum-Iron nitrogenase system comprising: nifH, nifD, nifK, nifB, nifE, nifN, nifX, hesA, nifV, nifW, nifU, nifS, nifI1, and nifI2. In some cases, a Gram positive microbe may have a vanadium nitrogenase system comprising: vnfDG, vnfK, vnfE, vnfN, vupC, vupB, vupA, vnfV, vnfR1, vnfH, vnfR2, vnfA (transcriptional regulator). In some cases, a Gram positive microbe may have an iron-only nitrogenase system comprising: anfK, anfG, anfD, anfH, anfA (transcriptional regulator). In some cases, a Gram positive microbe may have a nitrogenase system comprising glnB, and glnK (nitrogen signaling proteins). Some examples of enzymes involved in nitrogen metabolism in Gram positive microbes include glnA (glutamine synthetase), gdh (glutamate dehydrogenase), bdh (3-hydroxybutyrate dehydrogenase), glutaminase, gltAB/gltB/gltS (glutamate synthase), asnA/asnB (aspartate-ammonia ligase/asparagine synthetase), and ansA/ansZ (asparaginase). Some examples of proteins involved in nitrogen transport in Gram positive microbes include amtB (ammonium transporter), glnK (regulator of ammonium transport), glnPHQ/glnQHMP (ATP-dependent glutamine/glutamate transporters), glnT/alsT/yrbD/yflA (glutamine-like proton symport transporters), and gltP/gltT/yhcl/ngt (glutamate-like proton symport transporters).

Examples of Gram positive microbes which may be of particular interest include *Paenibacillus polymixa, Paenibacillus riograndensis, Paenibacillus* sp., *Frankia* sp., *Heliobacterium* sp., *Heliobacterium chlorum, Heliobacillus* sp., *Heliophilum* sp., *Heliorestis* sp., *Clostridium acetobutylicum, Clostridium* sp., *Mycobacterium flaum, Mycobacterium* sp., *Arthrobacter* sp., *Agromyces* sp., *Corynebacterium autitrophicum, Corynebacterium* sp., *Micromonspora* sp., *Propionibacteria* sp., *Streptomyces* sp., and *Microbacterium* sp., Some examples of genetic alterations which may be made in Gram positive microbes include: deleting glnR to remove negative regulation of BNF in the presence of environmental nitrogen, inserting different promoters directly upstream of the nif cluster to eliminate regulation by GlnR in response to environmental nitrogen, mutating glnA to reduce the rate of ammonium assimilation by the GS-GOGAT pathway, deleting amtB to reduce uptake of ammonium from the media, mutating glnA so it is constitutively in the feedback-inhibited (FBI-GS) state, to reduce ammonium assimilation by the GS-GOGAT pathway.

In some cases, glnR is the main regulator of N metabolism and fixation in *Paenibacillus* species. In some cases, the genome of a *Paenibacillus* species may not contain a gene to produce glnR In some cases, the genome of a *Paenibacillus* species may not contain a gene to produce glnE or glnD. In some cases, the genome of a *Paenibacillus* species may contain a gene to produce glnB or glnK. For example, *Paenibacillus* sp. WLY78 doesn't contain a gene for glnB, or its homologs found in the archaeon *Methanococcus maripaludis*, nifI1 and nifI2. In some cases, the genomes of *Paenibacillus* species may be variable. For example, *Paenibacillus polymixa* E681 lacks glnK and gdh, has several nitrogen compound transporters, but only amtB appears to be controlled by GlnR. In another example, *Paenibacillus* sp. JDR2 has glnK, gdh and most other central nitrogen metabolism genes, has many fewer nitrogen compound transporters, but does have glnPHQ controlled by GlnR. *Paenibacillus riograndensis* SBR5 contains a standard glnRA operon, an fdx gene, a main nif operon, a secondary nif operon, and an anf operon (encoding iron-only nitrogenase). Putative glnR/tnrA sites were found upstream of each of these operons. GlnR may regulate all of the above operons, except the anf operon. GlnR may bind to each of these regulatory sequences as a dimer.

*Paenibacillus* N-fixing strains may fall into two subgroups: Subgroup I, which contains only a minimal nif gene cluster and subgroup II, which contains a minimal cluster, plus an uncharacterized gene between nifX and hesA, and often other clusters duplicating some of the nif genes, such as nifH, nifHDK, nifBEN, or clusters encoding vanadium nitrogenase (vnf) or iron-only nitrogenase (anf) genes.

In some cases, the genome of a *Paenibacillus* species may not contain a gene to produce glnB or glnK In some cases, the genome of a *Paenibacillus* species may contain a minimal nif cluster with 9 genes transcribed from a sigma-70 promoter. In some cases, a *Paenibacillus* nif cluster may be negatively regulated by nitrogen or oxygen. In some cases, the genome of a *Paenibacillus* species may not contain a gene to produce sigma-S4. For example, *Paenibacillus* sp. WLY78 does not contain a gene for sigma-54. In some cases, a nif cluster may be regulated by glnR, and/or TnrA. In some cases, activity of a nif cluster may be altered by altering activity of glnR, and/or TnrA.

In Bacilli, glutamine synthetase (GS) is feedback-inhibited by high concentrations of intracellular glutamine, causing a shift in confirmation (referred to as FBI-GS). Nif clusters contain distinct binding sites for the regulators GlnR and TnrA in several Bacilli species. GlnR binds and represses gene expression in the presence of excess intracellular glutamine and AMP. A role of GlnR may be to prevent the influx and intracellular production of glutamine and ammonium under conditions of high nitrogen availability. TnrA may bind and/or activate (or repress) gene expression in the presence of limiting intracellular glutamine, and/or in the presence of FBI-GS. In some cases, the activity of a Bacilli nif cluster may be altered by altering the activity of GlnR.

Feedback-inhibited glutamine synthetase (FBI-GS) may bind GlnR and stabilize binding of GlnR to recognition sequences. Several bacterial species have a GlnR/TnrA binding site upstream of the nif cluster. Altering the binding of FBI-GS and GlnR may alter the activity of the nif pathway.

Sources of Microbes

The bacteria (or any microbe according to the disclosure) may be obtained from any general terrestrial environment, including its soils, plants, fungi, animals (including invertebrates) and other biota, including the sediments, water and biota of lakes and rivers; from the marine environment, its biota and sediments (for example, sea water, marine muds, marine plants, marine invertebrates (for example, sponges), marine vertebrates (for example, fish)); the terrestrial and marine geosphere (regolith and rock, for example, crushed subterranean rocks, sand and clays); the cryosphere and its meltwater; the atmosphere (for example, filtered aerial dusts, cloud and rain droplets); urban, industrial and other man-made environments (for example, accumulated organic and mineral matter on concrete, roadside gutters, roof surfaces, and road surfaces).

The plants from which the bacteria (or any microbe according to the disclosure) are obtained may be a plant having one or more desirable traits, for example a plant which naturally grows in a particular environment or under certain conditions of interest. By way of example, a certain plant may naturally grow in sandy soil or sand of high salinity, or under extreme temperatures, or with little water, or it may be resistant to certain pests or disease present in the environment, and it may be desirable for a commercial crop to be grown in such conditions, particularly if they are, for example, the only conditions available in a particular geographic location. By way of further example, the bacteria may be collected from commercial crops grown in such environments, or more specifically from individual crop plants best displaying a trait of interest amongst a crop grown in any specific environment: for example the fastest-growing plants amongst a crop grown in saline-limiting soils, or the least damaged plants in crops exposed to severe insect damage or disease epidemic, or plants having desired quantities of certain metabolites and other compounds, including fiber content, oil content, and the like, or plants displaying desirable colors, taste or smell. The bacteria may be collected from a plant of interest or any material occurring in the environment of interest, including fungi and other animal and plant biota, soil, water, sediments, and other elements of the environment as referred to previously.

The bacteria (or any microbe according to the disclosure) may be isolated from plant tissue. This isolation can occur from any appropriate tissue in the plant, including for example root, stem and leaves, and plant reproductive tissues. By way of example, conventional methods for isolation from plants typically include the sterile excision of the plant material of interest (e.g. root or stem lengths, leaves), surface sterilization with an appropriate solution (e.g. 2% sodium hypochlorite), after which the plant material is placed on nutrient medium for microbial growth. Alternatively, the surface-sterilized plant material can be crushed in a sterile liquid (usually water) and the liquid suspension, including small pieces of the crushed plant material spread over the surface of a suitable solid agar medium, or media, which may or may not be selective (e.g. contain only phytic acid as a source of phosphorus). This approach is especially useful for bacteria which form isolated colonies and can be picked off individually to separate plates of nutrient medium, and further purified to a single species by well-known methods. Alternatively, the plant root or foliage samples may not be surface sterilized but only washed gently thus including surface-dwelling epiphytic microorganisms in the isolation process, or the epiphytic microbes can be isolated separately, by imprinting and lifting off pieces of plant roots, stem or leaves onto the surface of an agar medium and then isolating individual colonies as above. This approach is especially useful for bacteria, for example. Alternatively, the roots may be processed without washing off small quantities of soil attached to the roots, thus including microbes that colonize the plant rhizosphere. Otherwise, soil adhering to the roots can be removed, diluted and spread out onto agar of suitable selective and non-selective media to isolate individual colonies of rhizospheric bacteria.

Budapest Treaty on the International Recognition of the Deposit of Microorganisms for the Purpose of Patent Procedures The microbial deposits of the present disclosure were made under the provisions of the Budapest Treaty on the International Recognition of the Deposit of Microorganisms for the Purpose of Patent Procedure (Budapest Treaty).

Applicants state that pursuant to 37 C.F.R. § 1.808(a)(2) "all restrictions imposed by the depositor on the availability to the public of the deposited material will be irrevocably removed upon the granting of the patent" This statement is subject to paragraph (b) of this section (i.e. 37 C.F.R. § 1.808(b)).

The *Enterohacter sacchari* has now been reclassified as *Kosakonia sacchari*; the name for the organism may be used interchangeably throughout the manuscript.

Many microbes of the present disclosure are derived from two wild-type strains. Strain CI006 is a bacterial species previously classified in the genus *Enterobacter* (see aforementioned reclassification into Kosakonia). Strain CI019 is a bacterial species classified in the genus Rahnella. The deposit information for the CI006 Kosakonia wild type (WT) and CI019 Rahnella WT are found in the below Table 1.

Some microorganisms described in this application were deposited on Jan. 6, 2017 or Aug. 11, 2017 with the Bigelow National Center for Marine Algae and Microbiota (NCMA), located at 60 Bigelow Drive, East Boothbay, Me. 04544, USA. As aforementioned, all deposits were made under the terms of the Budapest Treaty on the International Recognition of the Deposit of Microorganisms for the Purposes of Patent Procedure. The Bigelow National Center for Marine Algae and Microbiota accession numbers and dates of deposit for the aforementioned Budapest Treaty deposits are provided in Table 1.

Biologically pure cultures of *Kosakonia sacchari* (WT), *Rahnella aquatilis* (WT), and a variant/remodeled *Kosakonia sacchari* strain were deposited on Jan. 6, 2017 with the Bigelow National Center for Marine Algae and Microbiota (NCMA), located at 60 Bigelow Drive, East Boothbay, Me. 04544, USA, and assigned NCMA Patent Deposit Designation numbers 201701001, 201701003, and 201701002, respectively. The applicable deposit information is found below in Table 1.

Biologically pure cultures of variant/remodeled *Kosakonia sacchari* strains were deposited on Aug. 11, 2017 with the Bigelow National Center for Marine Algae and Microbiota (NCMA), located at 60 Bigelow Drive, East Boothbay, Me. 04544, USA, and assigned NCMA Patent Deposit Designation numbers 201708004, 201708003, and 201708002, respectively. The applicable deposit information is found below in Table 1.

A biologically pure culture of *Klebsiella variicola* (W7) was deposited on Aug. 11, 2017 with the Bigelow National Center for Marine Algae and Microbiota (NCMA), located at 60 Bigelow Drive, East Boothbay, Me. 04544, USA, and assigned NCMA Patent Deposit Designation number 201708001. Biologically pure cultures of two *Klebsiella* variicola variants/remodeled strains were deposited on Dec. 20, 2017 with the Bigelow National Center for Marine Algae and Microbiota (NCMA), located at 60 Bigelow Drive, East Boothbay, Me. 04544, USA, and assigned NCMA Patent Deposit Designation numbers 201712001 and 201712002, respectively. The applicable deposit information is found below in Table 1.

TABLE 1

| Microorganisms Deposited under the Budapest Treaty | | | | |
|---|---|---|---|---|
| Depository | Pivot Strain Designation (some strains have multiple designations) | Taxonomy | Accession Number | Date of Deposit |
| NCMA | CI006, PBC6.1, 6 | *Kosakonia sacchari* (WT) | 201701001 | Jan. 6, 2017 |
| NCMA | CI019, 19 | *Rahnella aquatilis* (WT) | 201701003 | Jan. 6, 2017 |
| NCMA | CM029, 6-412 | *Kosakonia sacchari* | 201701002 | Jan. 6, 2017 |
| NCMA | 6-403 CM037 | *Kosakonia sacchari* | 201708004 | Aug. 11, 2017 |
| NCMA | 6-404, CM38, PBC6.38 | *Kosakonia sacchari* | 201708003 | Aug. 11, 2017 |
| NCMA | CM094, 6-881, PBC6.94 | *Kosakonia sacchari* | 201708002 | Aug. 11, 2017 |
| NCMA | CI137, 137, PB137 | *Klebsiella variicola* (WT) | 201708001 | Aug. 11, 2017 |
| NCMA | 137-1034 | *Klebsiella variicola* | 201712001 | Dec. 20, 2017 |
| NCMA | 137-1036 | *Klebsiella variicola* | 201712002 | Dec. 20, 2017 |

Isolated and Biologically Pure Microorganisms

The present disclosure, in certain embodiments, provides isolated and biologically pure microorganisms that have applications, inter cilia, in agriculture. The disclosed microorganisms can be utilized in their isolated and biologically pure states, as well as being formulated into compositions (see below section for exemplary composition descriptions). Furthermore, the disclosure provides microbial compositions containing at least two members of the disclosed isolated and biologically pure microorganisms, as well as methods of utilizing said microbial compositions. Furthermore, the disclosure provides for methods of modulating nitrogen fixation in plants via the utilization of the disclosed isolated and biologically pure microbes.

In some aspects, the isolated and biologically pure microorganisms of the disclosure are those from Table 1. In other aspects, the isolated and biologically pure microorganisms of the disclosure are derived from a microorganism of Table 1. For example, a strain, child, mutant, or derivative, of a microorganism from Table 1 are provided herein. The disclosure contemplates all possible combinations of microbes listed in Table 1, said combinations sometimes forming a microbial consortia. The microbes from Table 1, either individually or in any combination, can be combined with any plant, active molecule (synthetic, organic, etc.), adjuvant, carrier, supplement, or biological, mentioned in the disclosure.

In some aspects, the disclosure provides microbial compositions comprising species as grouped in Tables 2-8. In some aspects, these compositions comprising various microbial species are termed a microbial consortia or consortium.

With respect to Tables 2-8, the letters A through I represent a non-limiting selection of microorganisms of the present disclosure, defined as:

A=Microbe with accession number 201701001 identified in Table 1;

B=Microbe with accession number 201701003 identified in Table 1;

C=Microbe with accession number 201701002 identified in Table 1;

D=Microbe with accession number 201708004 identified in Table 1;

E=Microbe with accession number 201708003 identified in Table 1;

F=Microbe with accession number 201708002 identified in Table 1;

G=Microbe with accession number 201708001 identified in Table 1;

H=Microbe with accession number 201712001 identified in Table 1; and

I=Microbe with accession number 201712002 identified in Table 1.

TABLE 2

| Eight and Nine Strain Compositions | | | | | |
|---|---|---|---|---|---|
| A, B, C, D, E, F, G, H | A, B, C, D, E, F, G, I | A, B, C, D, E, F, H, I | A, B, C, D, E, G, H, I | A, B, C, D, F, G, H, I | A, B, C, E, F, G, H, I |
| A, B, D, E, F, G, H, I | A, C, D, E, F, G, H, I | B, C, D, E, F, G, H, I | A, B, C, D, E, F, G, H, I | | |

TABLE 3

| Seven Strain Compositions | | | | | |
|---|---|---|---|---|---|
| A, B, C, D, E, F, G | A, B, C, D, E, F, H | A, B, C, D, E, F, I | A, B, C, D, E, G, H | A, B, C, D, E, G, I | A, B, C, D, E, H, I |
| A, B, C, D, F, G, H | A, B, C, D, F, G, I | A, B, C, D, F, H, I | A, B, C, D, G, H, I | A, B, C, E, F, G, H | A, B, C, E, F, G, I |
| A, B, C, E, F, H, I | A, B, C, E, G, H, I | A, B, C, F, G, H, I | A, B, D, E, F, G, H | A, B, D, E, F, G, I | A, B, D, E, F, H, I |

TABLE 3-continued

| Seven Strain Compositions | | | | | |
|---|---|---|---|---|---|
| A, B, D, E, G, H, I | A, B, D, F, G, H, I | A, B, E, F, G, H, I | A, C, D, E, F, G, H | A, C, D, E, F, G, I | A, C, D, E, F, H, I |
| A, C, D, E, G, H, I | A, C, D, F, G, H, I | A, C, E, F, G, H, I | A, D, E, F, G, H, I | B, C, D, E, F, G, H | B, C, D, E, F, G, I |
| B, C, D, E, F, H, I | B, C, D, E, G, H, I | B, C, D, F, G, H, I | | B, D, E, F, G, H, I | C, D, E, F, G, H, I |

TABLE 4

| Six Strain Compositions | | | | | | |
|---|---|---|---|---|---|---|
| A, B, C, D, E, F | A, B, C, D, E, G | A, B, C, D, E, H | A, B, C, D, E, I | A, B, C, D, F, G | A, B, C, D, F, H | A, B, C, D, F, I |
| A, B, C, D, G, H | A, B, C, D, G, I | A, B, C, D, H, I | A, B, C, E, F, G | A, B, C, E, F, H | A, B, C, E, F, I | A, B, C, E, G, H |
| A, B, C, E, G, I | A, B, C, E, H, I | A, B, C, F, G, H | A, B, C, F, G, I | A, B, C, F, H, I | A, B, C, G, H, I | A, B, D, E, F, G |
| A, B, D, E, F, H | A, B, D, E, F, I | A, B, D, E, G, H | A, B, D, E, G, I | A, B, D, E, H, I | A, B, D, F, G, H | A, B, D, F, G, I |
| D, E, F, G, H, I | C, E, F, G, H, I | A, B, D, F, H, I | A, B, D, G, H, I | A, B, E, F, G, H | A, B, E, F, G, I | A, B, E, F, H, I |
| A, B, E, G, H, I | A, B, F, G, H, I | A, C, D, E, F, G | A, C, D, E, F, H | A, C, D, E, F, I | A, C, D, E, G, H | A, C, D, E, G, I |
| A, C, D, E, H, I | A, C, D, F, G, H | A, C, D, F, G, I | A, C, D, F, H, I | A, C, D, G, H, I | A, C, E, F, G, H | A, C, E, F, G, I |
| A, C, E, F, H, I | A, C, E, G, H, I | A, C, F, G, H, I | A, D, E, F, G, H | A, D, E, F, G, I | A, D, E, F, H, I | A, D, E, G, H, I |
| A, D, F, G, H, I | A, E, F, G, H, I | B, C, D, E, F, G | B, C, D, E, F, H | B, C, D, E, F, I | B, C, D, E, G, H | B, C, D, E, G, I |
| B, C, D, E, H, I | B, C, D, F, G, H | B, C, D, F, G, I | B, C, D, F, H, I | B, C, D, G, H, I | B, C, E, F, G, H | B, C, E, F, G, I |
| B, C, E, F, H, I | B, C, E, G, H, I | B, C, F, G, H, I | B, D, E, F, G, H | B, D, E, F, G, I | B, D, E, F, H, I | B, D, E, G, H, I |
| B, D, F, G, H, I | B, E, F, G, H, I | C, D, E, F, G, H | C, D, E, F, G, I | C, D, E, F, H, I | C, D, E, G, H, I | C, D, F, G, H, I |

TABLE 5

| Five Strain Compositions | | | | | | | |
|---|---|---|---|---|---|---|---|
| A, B, C, D, E | A, B, C, D, F | A, B, C, D, G | A, B, C, D, H | A, B, C, D, I | A, B, C, E, F | A, B, C, E, G | A, B, C, E, H |
| A, B, C, F, H | A, B, C, F, G | A, B, C, F, I | A, B, C, G, H | A, B, C, G, I | A, B, C, H, I | A, B, D, E, F | A, B, D, E, G |
| A, B, D, E, I | A, B, D, F, G | A, B, D, F, H | A, B, D, F, I | A, B, D, G, H | A, B, D, G, I | A, B, D, H, I | A, B, E, F, G |
| A, B, E, F, I | A, B, E, G, H | A, B, E, G, I | A, B, E, H, I | A, B, F, G, H | A, B, F, G, I | A, B, F, H, I | A, B, G, H, I |
| A, C, D, E, G | A, C, D, E, H | A, C, D, E, I | A, C, D, F, G | A, C, D, F, H | A, C, D, F, I | A, C, D, G, H | A, C, D, G, I |
| A, C, E, F, G | A, C, E, F, H | A, C, E, F, I | A, C, E, G, H | A, C, E, G, I | A, C, E, H, I | A, C, F, G, H | A, C, F, G, I |
| A, C, G, H, I | A, D, E, F, G | A, D, E, F, H | A, D, E, F, I | A, D, E, G, H | A, D, E, G, I | A, D, E, H, I | A, D, F, G, H |
| A, D, F, H, I | A, D, G, H, I | A, E, F, G, H | A, E, F, G, I | A, E, F, H, I | A, E, G, H, I | A, F, G, H, I | B, C, D, E, F |
| B, C, D, E, H | B, C, D, E, I | B, C, D, F, G | B, C, D, F, H | B, C, D, F, I | B, C, D, G, H | B, C, D, G, I | B, C, D, H, I |
| B, C, E, F, H | B, C, E, F, I | B, C, E, G, H | B, C, E, G, I | B, C, E, H, I | B, C, F, G, H | B, C, F, G, I | B, C, F, H, I |
| B, D, E, F, G | B, D, E, F, H | B, D, E, F, I | B, D, E, G, H | B, D, E, G, I | B, D, E, H, I | B, D, F, G, H | B, D, F, G, I |
| B, D, G, H, I | B, E, F, G, H | B, E, F, G, I | B, E, F, H, I | B, E, G, H, I | B, F, G, H, I | C, D, E, F, G | C, D, E, F, H |
| C, D, E, G, H | C, D, E, G, I | C, D, E, H, I | C, D, F, G, H | C, D, F, G, I | C, D, F, H, I | C, D, G, H, I | C, E, F, G, H |
| C, E, F, H, I | C, E, G, H, I | C, F, G, H, I | D, E, F, G, H | D, E, F, G, I | D, E, F, H, I | D, E, G, H, I | D, F, G, H, I |
| A, B, C, E, I | A, B, D, E, H | A, B, E, F, H | A, C, D, E, F | A, C, D, H, I | A, C, F, H, I | A, D, F, G, I | B, C, D, E, G |
| B, C, E, F, G | B, C, G, H, I | B, D, F, H, I | C, D, E, F, I | C, E, F, G, I | E, F, G, H, I | | |

TABLE 6

| Four Strain Compositions | | | | | | | | |
|---|---|---|---|---|---|---|---|---|
| A, B, C, D | A, B, C, E | A, B, C, F | A, B, C, G | A, B, C, H | A, B, C, I | A, B, D, E | A, B, D, F | D, G, H, I |
| A, B, D, G | A, B, D, H | A, B, D, I | A, B, E, F | A, B, E, G | A, B, E, H | A, B, E, I | A, B, F, G | E, F, G, H |
| A, B, F, H | A, D, F, H | A, D, F, I | A, D, G, H | A, D, G, I | A, D, H, I | A, E, F, G | A, E, F, H | E, F, G, I |
| A, B, F, I | A, B, G, H | A, B, G, I | A, B, H, I | A, C, D, E | A, C, D, F | A, C, D, G | A, C, D, H | E, F, H, I |
| A, C, D, I | A, C, E, F | A, C, E, G | A, C, E, H | A, C, E, I | A, C, F, G | A, C, F, H | A, C, F, I | E, G, H, I |
| A, C, G, H | A, C, G, I | A, C, H, I | A, D, E, F | A, D, E, G | A, D, E, H | A, D, E, I | A, D, F, G | F, G, H, I |
| A, E, F, I | A, E, G, H | A, E, G, I | A, E, H, I | A, F, G, H | A, F, G, I | A, F, H, I | A, G, H, I | D, E, F, H |
| B, C, D, E | B, C, D, F | B, C, D, G | B, C, D, H | B, C, D, I | B, C, E, F | B, C, E, G | B, C, E, H | D, E, F, I |
| B, C, E, I | B, C, F, G | B, C, F, H | B, C, F, I | B, C, G, H | B, C, G, I | B, C, H, I | B, D, E, F | D, E, G, H |
| B, D, E, G | B, D, E, H | B, D, E, I | B, D, F, G | B, D, F, H | B, D, F, I | B, D, G, H | B, D, G, I | D, E, G, I |
| B, D, H, I | B, E, F, G | B, E, F, H | B, E, F, I | B, E, G, H | B, E, G, I | B, E, H, I | B, F, G, H | D, E, H, I |
| B, F, G, I | B, F, H, I | B, G, H, I | C, D, E, F | C, D, E, G | C, D, E, H | C, D, E, I | C, D, F, G | D, F, G, H |
| C, D, F, H | C, D, F, I | C, D, G, H | C, D, G, I | C, D, H, I | C, E, F, G | C, E, F, H | C, E, F, I | D, F, G, I |
| C, E, G, H | C, E, G, I | C, E, H, I | C, F, G, H | C, F, G, I | C, F, H, I | C, G, H, I | D, E, F, G | D, F, H, I |

TABLE 7

| Three Strain Compositions | | | | | | | | | | |
|---|---|---|---|---|---|---|---|---|---|---|
| A, B, C | A, B, D | A, B, E | A, B, F | A, B, G | A, B, H | A, B, I | A, C, D | A, C, E | G, H, I | E, F, H |
| A, C, F | A, C, G | A, C, H | A, C, I | A, D, E | A, D, F | A, D, G | A, D, H | A, D, I | F, H, I | E, F, G |
| A, E, F | A, E, G | A, E, H | A, E, I | A, F, G | A, F, H | A, F, I | A, G, H | A, G, I | F, G, I | D, H, I |
| A, H, I | B, C, D | B, C, E | B, C, F | B, C, G | B, C, H | B, C, I | B, D, E | B, D, F | F, G, H | D, G, I |
| B, D, G | B, D, H | B, D, I | B, E, F | B, E, G | B, E, H | B, E, I | B, F, G | B, F, H | E, H, I | E, F, I |
| B, F, I | B, G, H | B, G, I | B, H, I | C, D, E | C, D, F | C, D, G | C, D, H | C, D, I | E, G, I | D, G, H |
| C, E, F | C, E, G | C, E, H | C, E, I | C, F, G | C, F, H | C, F, I | C, G, H | C, G, I | E, G, H | D, F, I |
| C, H, I | D, E, F | D, E, G | D, E, H | D, E, I | D, F, G | D, F, H | | | | |

TABLE 8

| Two Strain Compositions | | | | | | | | | | | | | | | |
|---|---|---|---|---|---|---|---|---|---|---|---|---|---|---|---|
| A, B | A, C | A, D | A, E | A, F | A, G | A, H | A, I | B, C | B, D | B, E | B, F | B, G | B, H | B, I | C, D |
| C, E | C, F | C, G | C, H | C, I | D, E | D, F | D, G | D, H | D, I | E, F | E, G | E, H | E, I | F, G | F, H |
| F, I | G, H | G, I | H, I | | | | | | | | | | | | |

In some embodiments, microbial compositions may be selected from any member group from Tables 2-8.

In some embodiments, any microbe of the present disclosure may be modified or optimized to excrete ammonium constitutively or non-constitutively. In some embodiments, the modification of any microbe of the present disclosure is a transgenic modification. In some embodiments, the microbes are already a transgenic organism and the strains are modified such that they no longer contain a transgenic element. In some embodiments, the modification of any microbe of the present disclosure is a non-transgenic modification. In some embodiments, any two or more PGPR are combined in a microbial consortia. In some embodiments, any two or more microbes of the present disclosure, or those derived therefrom, are combined in a microbial consortia. In some embodiments, the microbial consortia are applied to any one or more plants of the present disclosure and/or the surrounding soil or growth medium. In some embodiments, any PGPR is applied to any one or more of the plants of the present disclosure and/or the surrounding soil or growth medium.

In some embodiments, the microbes of the present disclosure are modified or optimized to enhance or increase the ability to colonize plants. In some embodiments, the enhanced or increased ability to colonize plants is an enhanced or increased ability to colonize the surface of the roots.

Agricultural Compositions

Compositions comprising bacteria or bacterial populations produced according to methods described herein and/or having characteristics as described herein can be in the form of a liquid, a foam, or a dry product. Compositions comprising bacteria or bacterial populations produced according to methods described herein and/or having characteristics as described herein may also be used to improve plant traits. In some examples, a composition comprising bacterial populations may be in the form of a dry powder, a slurry of powder and water, or a flowable seed treatment. The compositions comprising bacterial populations may be coated on a surface of a seed, and may be in liquid form.

The composition can be fabricated in bioreactors such as continuous stirred tank reactors, batch reactors, and on the farm. In some examples, compositions can be stored in a container, such as a jug or in mini bulk. In some examples, compositions may be stored within an object selected from the group consisting of a bottle, jar, ampule, package, vessel, bag, box, bin, envelope, carton, container, silo, shipping container, truck bed, and/or case.

Compositions may also be used to improve plant traits. In some examples, one or more compositions may be coated onto a seed. In some examples, one or more compositions may be coated onto a seedling. In some examples, one or more compositions may be coated onto a surface of a seed. In some examples, one or more compositions may be coated as a layer above a surface of a seed. In some examples, a composition that is coated onto a seed may be in liquid form, in dry product form, in foam form, in a form of a slurry of powder and water, or in a flowable seed treatment. In some examples, one or more compositions may be applied to a seed and/or seedling by spraying, immersing, coating, encapsulating, and/or dusting the seed and/or seedling with the one or more compositions. In some examples, multiple bacteria or bacterial populations can be coated onto a seed and/or a seedling of the plant. In some examples, at least two, at least three, at least four, at least five, at least six, at least seven, at least eight, at least nine, at least ten, or more than ten bacteria of a bacterial combination can be selected from one of the following genera: *Acidovorax, Agrobacterium, Bacillus, Burkholderia, Chryseobacterium, Curtobacterium, Enterobacter, Escherichia, Methylobacterium, Paenibacillus, Pantoea, Pseudomonas, Ralstonia, Saccharibacillus, Sphingomonas*, and *Stenotrophomonas*.

In some examples, at least two, at least three, at least four, at least five, at least six, at least seven, at least eight, at least nine, at least ten, or more than ten bacteria and bacterial populations of an endophytic combination are selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae, Cladosporiaceae, Gnomoniaceae, *Incertae sedis*, Lasiosphaeriaceae, Netriaceae, and Pleosporaceae.

In some examples, at least two, at least three, at least four, at least five, at least six, at least seven, at least eight, at least night, at least ten, or more than ten bacteria and bacterial populations of an endophytic combination are selected from one of the following families: Bacillaceae, Burkholderiaceae, Comamonadaceae, Enterobacteriaceae, Flavobacteriaceae, Methylobacteriaceae, Microbacteriaceae, Paenibacillileae, Pseudomonnaceae, Rhizobiaceae, Sphingomonadaceae, Xanthomonadaceae, Cladosporiaceae, Gnomoniaceae, *Incertae sedis*, Lasiosphaeriaceae, Netriaceae, Pleosporaceae.

Examples of compositions may include seed coatings for commercially important agricultural crops, for example, sorghum, canola, tomato, strawberry, barley, rice, maize, and wheat. Examples of compositions can also include seed coatings for corn, soybean, canola, sorghum, potato, rice, vegetables, cereals, and oilseeds. Seeds as provided herein can be genetically modified organisms (GMO), non-GMO, organic, or conventional. In some examples, compositions may be sprayed on the plant aerial parts, or applied to the roots by inserting into furrows in which the plant seeds are planted, watering to the soil, or dipping the roots in a suspension of the composition. In some examples, compositions may be dehydrated in a suitable manner that maintains cell viability and the ability to artificially inoculate and colonize host plants. The bacterial species may be present in compositions at a concentration of between 10 g to $10^{10}$ CFU/ml. In some examples, compositions may be supplemented with trace metal ions, such as molybdenum ions, iron ions, manganese ions, or combinations of these ions. The concentration of ions in examples of compositions as described herein may between about 0.1 mM and about 50 mM. Some examples of compositions may also be formulated with a carrier, such as beta-glucan, carboxylmethyl cellulose (CMC), bacterial extracellular polymeric substance (EPS), sugar, animal milk, or other suitable carriers. In some examples, peat or planting materials can be used as a carrier, or biopolymers in which a composition is entrapped in the biopolymer can be used as a carrier. The compositions comprising the bacterial populations described herein can improve plant traits, such as promoting plant growth, maintaining high chlorophyll content in leaves, increasing fruit or seed numbers, and increasing fruit or seed unit weight.

The compositions comprising the bacterial populations described herein may be coated onto the surface of a seed. As such, compositions comprising a seed coated with one or more bacteria described herein are also contemplated. The seed coating can be formed by mixing the bacterial population with a porous, chemically inert granular carrier. Alternatively, the compositions may be inserted directly into the furrows into which the seed is planted or sprayed onto the plant leaves or applied by dipping the roots into a suspension of the composition. An effective amount of the composition can be used to populate the sub-soil region adjacent to the roots of the plant with viable bacterial growth, or populate the leaves of the plant with viable bacterial growth. In general, an effective amount is an amount sufficient to result in plants with improved traits (e.g. a desired level of nitrogen fixation).

Bacterial compositions described herein can be formulated using an agriculturally acceptable carrier. The formulation useful for these embodiments may include at least one member selected from the group consisting of a tackifier, a microbial stabilizer, a fungicide, an antibacterial agent, a preservative, a stabilizer, a surfactant, an anti-complex agent, an herbicide, a nematicide, an insecticide, a plant growth regulator, a fertilizer, a rodenticide, a desiccant, a bactericide, a nutrient, or any combination thereof. In some examples, compositions may be shelf-stable. For example, any of the compositions described herein can include an agriculturally acceptable carrier (e.g., one or more of a fertilizer such as a non-naturally occurring fertilizer, an adhesion agent such as a non-naturally occurring adhesion agent, and a pesticide such as a non-naturally occurring pesticide). A non-naturally occurring adhesion agent can be, for example, a polymer, copolymer, or synthetic wax. For example, any of the coated seeds, seedlings, or plants described herein can contain such an agriculturally acceptable carrier in the seed coating. In any of the compositions or methods described herein, an agriculturally acceptable carrier can be or can include a non-naturally occurring compound (e.g., a non-naturally occurring fertilizer, a non-naturally occurring adhesion agent such as a polymer, copolymer, or synthetic wax, or a non-naturally occurring pesticide). Non-limiting examples of agriculturally acceptable carriers are described below. Additional examples of agriculturally acceptable carriers are known in the art.

In some cases, bacteria are mixed with an agriculturally acceptable carrier. The carrier can be a solid carrier or liquid carrier, and in various forms including microspheres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in the composition. Water-in-oil emulsions can also be used to formulate a composition that includes the isolated bacteria (see, for example, U.S. Pat. No. 7,485,451). Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pests (flour and kaolin clay), agar or flour-based pellets in loam, sand, or clay, etc. Formulations may include food sources for the bacteria, such as barley, rice, or other biological materials such as seed, plant parts, sugar cane bagasse, hulls or stalks from grain processing, ground plant material or wood from building site refuse, sawdust or small fibers from recycling of paper, fabric, or wood.

For example, a fertilizer can be used to help promote the growth or provide nutrients to a seed, seedling, or plant. Non-limiting examples of fertilizers include nitrogen, phosphorous, potassium, calcium, sulfur, magnesium, boron, chloride, manganese, iron, zinc, copper, molybdenum, and selenium (or a salt thereof). Additional examples of fertilizers include one or more amino acids, salts, carbohydrates, vitamins, glucose, NaCl, yeast extract, $NH_4H_2PO_4$, $(NH_4)_2SO_4$, glycerol, valine, L-leucine, lactic acid, propionic acid, succinic acid, malic acid, citric acid, KH tartrate, xylose, lyxose, and lecithin. In one embodiment, the formulation can include a tackifier or adherent (referred to as an adhesive agent) to help bind other active agents to a substance (e.g., a surface of a seed). Such agents are useful for combining bacteria with carriers that can contain other compounds (e.g., control agents that are not biologic), to yield a coating composition. Such compositions help create coatings around the plant or seed to maintain contact between the microbe and other agents with the plant or plant part. In one embodiment, adhesives are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers.

In some embodiments, the adhesives can be, e.g. a wax such as carnauba wax, beeswax, Chinese wax, shellac wax, spermaceti wax, candelilla wax, castor wax, ouricury wax, and rice bran wax, a polysaccharide (e.g., starch, dextrins, maltodextrins, alginate, and chitosans), a fat, oil, a protein (e.g., gelatin and zeins), gum ambles, and shellacs. Adhesive agents can be non-naturally occurring compounds, e.g., polymers, copolymers, and waxes. For example, non-limiting examples of polymers that can be used as an adhesive agent include: polyvinyl acetates, polyvinyl acetate copolymers, ethylene vinyl acetate (EVA) copolymers, polyvinyl alcohols, polyvinyl alcohol copolymers, celluloses (e.g., ethylcelluloses, methylcelluloses, hydroxymethylcelluloses, hydroxypropylcelluloses, and carboxymethylcelluloses), polyvinylpyrolidones, vinyl chloride, vinylidene chloride copolymers, calcium lignosulfonates, acrylic copolymers, polyvinylacrylates, polyethylene oxide, acylamide polymers and copolymers, polyhydroxyethyl acrylate, methylacrylamide monomers, and polychloroprene.

In some examples, one or more of the adhesion agents, anti-fungal agents, growth regulation agents, and pesticides (e.g., insecticide) are non-naturally occurring compounds (e.g., in any combination). Additional examples of agriculturally acceptable carriers include dispersants (e.g., polyvinylpyrrolidone/vinyl acetate PVPIVA S-630), surfactants, binders, and filler agents.

The formulation can also contain a surfactant. Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v, v to 1% v/v.

In certain cases, the formulation includes a microbial stabilizer. Such an agent can include a desiccant, which can include any compound or mixture of compounds that can be classified as a desiccant regardless of whether the compound or compounds are used in such concentrations that they in fact have a desiccating effect on a liquid inoculant. Such desiccants are ideally compatible with the bacterial population used, and should promote the ability of the microbial population to survive application on the seeds and to survive desiccation. Examples of suitable desiccants include one or more of trehalose, sucrose, glycerol, and Methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% to about 35%, or between about 20% to about 30%. In some cases, it is advantageous for the formulation to contain agents such as a fungicide, an antibacterial agent, an herbicide, a nematicide, an insecticide, a plant growth regulator, a rodenticide, bactericide, or a nutrient. In some examples, agents may include protectants that provide protection against seed surface-borne pathogens. In some examples, protectants may provide some level of control of soil-borne pathogens. In some examples, protectants may be effective predominantly on a seed surface.

In some examples, a fungicide may include a compound or agent, whether chemical or biological, that can inhibit the growth of a fungus or kill a fungus. In some examples, a fungicide may include compounds that may be fungistatic or fungicidal. In some examples, fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

In some examples, fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants. In some examples, fungicide can be a biological control agent, such as a bacterium or fungus. Such organisms may be parasitic to the pathogenic fungi, or secrete toxins or other substances which can kill or otherwise prevent the growth of fungi. Any type of fungicide, particularly ones that are commonly used on plants, can be used as a control agent in a seed composition.

In some examples, the seed coating composition comprises a control agent which has antibacterial properties. In one embodiment, the control agent with antibacterial properties is selected from the compounds described herein elsewhere. In another embodiment, the compound is Streptomycin, oxytetracycline, oxolinic acid, or gentamicin. Other examples of antibacterial compounds which can be used as part of a seed coating composition include those based on dichlorophene and benzylalcohol hemi formal (Proxel® from ICI or Acticide® RS from Thor Chemie and Kathon® MK 25 from Rohm & Haas) and isothiazolinone derivatives such as alkylisothiazolinones and benzisothiazolinones (Acticide® MBS from Thor Chemie).

In some examples, growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione phosphorotrithioate, 2,3,5-tri-iodobenzoic acid, trinexapac-ethyl and uniconazole. Additional non-limiting examples of growth regulators include brassinosteroids, cytokinines (e.g., kinetin and zeatin), auxins (e.g., indolylacetic acid and indolylacetyl aspartate), flavonoids and isoflavanoids (e.g., formononetin and diosmetin), phytoaixins (e.g., glyceolline), and phytoalexin-inducing oligosaccharides (e.g., pectin, chitin, chitosan, polygalacuronic acid, and oligogalacturonic acid), and gibellerins. Such agents are ideally compatible with the agricultural seed or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

Some examples of nematode-antagonistic biocontrol agents include ARF18; 30 *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and Rhizobacteria. Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium vixens, Hirsutella rhossiliensis, Hirsutella minnesotensis, Lecanicillium lecanii, Monacrosporium drechsleri, Monacrosporium gephyropagum, Myrotehcium verrucaria, Neocosmospora vasinfecta, Paecilomyces lilacinus, Pochonia chlamydosporia, Stagonospora heteroderae, Stagonospora phaseoli*, vesicular-arbuscular mycorrhizal fungi, *Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and Rhizobacteria.

Some examples of nutrients can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Some examples of rodenticides may include selected from the group of substances consisting of 2-isovalerylindan-1, 3-dione, 4-(quinoxalin-2-ylamino) benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

In the liquid form, for example, solutions or suspensions, bacterial populations can be mixed or suspended in water or in aqueous solutions. Suitable liquid diluents or carriers include water, aqueous solutions, petroleum distillates, or other liquid carriers.

Solid compositions can be prepared by dispersing the bacterial populations in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

Pests

Agricultural compositions of the disclosure, which may comprise any microbe taught herein, are sometimes combined with one or more pesticides.

The pesticides that are combined with the microbes of the disclosure may target any of the pests mentioned below.

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dennaptera, Isoptera, Anoplura, Siphonaptera, Trichoptera, etc., particularly Lepidoptera and Coleoptera.

Those skilled in the art will recognize that not all compounds are equally effective against all pests. Compounds that may be combined with microbes of the disclosure may display activity against insect pests, which may include economically important agronomic, forest, greenhouse, nursery ornamentals, food and fiber, public and animal health, domestic and commercial structure, household and stored product pests.

As aforementioned, the agricultural compositions of the disclosure (which may comprise any microbe taught herein) are in embodiments combined with one or more pesticides. These pesticides may be active against any of the following pests:

Larvae of the order Lepidoptera include, but are not limited to, armyworms, cutworms, loopers and heliothines in the family Noctuidae *Spodoptera frugiperda* J E Smith (fall armyworm); *S. exigua* Hubner (beet armyworm); *S. litura* Fabricius (tobacco cutworm, cluster caterpillar); *Mainestra configurata* Walker (bertha armyworm); *M. brassicae* Linnaeus (cabbage moth); *Agrolis ipsilon* Hufnagel (black cutworm); *A. orthogonia* Morrison (western cutworm); *A. subterranea* Fabricius (granulate cutworm); *Alabama argillacea* Hubner (cotton leaf worm); *Trichoplusia ni* Hubner (cabbage looper); *Pseudoplusia includens* Walker (soybean looper); *Anticarsia gemmatalis* Hubner (velvet bean caterpillar); *Hypena scabra* Fabricius (green clover worm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insu-*

*lana* Boisduval (spiny bollworm); *E. vittella* Fabricius (spotted bollworm); *Helicoverpa armigera* Hubner (American bollworm); *H. zea* Boddie (corn earworm or cotton bollworm); *Melanchra pitta* Harris (zebra caterpillar); *Egira* (Xylomyges) curtails Grote (citrus cutworm); borers, case bearers, webworms, coneworms, and skeletonizers from the family Pyralidae *Ostrinia nubilalis* Hubner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenee (rice leaf roller); *Desmia funeralis* Hubner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hubner (tobacco (cacao) moth); *Galleria mellonella* Linnaeus (greater wax moth); *Hetpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Afaruca testulalis* Geyer (bean pod borer); *Plodia interpunctella* Hubner (Indian meal moth); *Scirpophaga incertulas* Walker (yellow stem borer); *Udea rubigalis* Guenee (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit *tortrix* moth); *Cochylis hospes* Walsingham (banded sunflower moth); *Cydia latiferreana* Walsingham (filbertworm); *C. pomonella* Linnaeus (colding moth); *Platynota favedana* Clemens (variegated leafroller); *P. stultana* Walsingham (omnivorous leafroller); *Lobesia botrana* Denis & Schiffermuller (European grape vine moth); *Spilonota ocellana* Denis & Schiffermuller (eyespotted bud moth); *Endopiza viteana* Clemens (grape bevy moth); *Eupoecilia ambiguella* Hubner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guerin-Meneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hubner (elm spanworm); *Erannis tiliaria* Harris (linden looper); *Euproctis chrysorrhoea* Linnaeus (browntail moth); *Harrisina americana* Guerin-Meneville (grapeleaf skeletonizer); *Hemileuca oliviae* Cockrell (range caterpillar); *Hyphantria cunea* Drury (fall web-worm); *Keiferia lycopersicella* Walsingham (tomato pinworm); *Lambdina fiscellaria* fiscellaria Hulst (Eastern hemlock looper); *L. fiscellaria* lugubrosa Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato homworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutell xylostella* Linnaeus (diamondback moth); *Pectinophora gossypiella* Saunders (pink bollworm); *Pontia protodice* Boisduval and Leconte (Southern cabbage-worm); *Sabulodes aegrotata* Guenee (onmivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothes moth); *Tuta absoluta* Meyrick (tomato leafminer); *Yponomeuta padella* Linnaeus (ermine moth); *Heliothis subflexa* Guenee; *Malacosoma* spp. and *Orgyia* spp.; *Ostrinia nubilalis* (European corn borer); seed corn maggot; *Agrolis ipsilon* (black cutworm).

Larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); Zygogramma exclamations Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Afelanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae; *Cerotoma* trifurcate (bean leaf beetle); and wireworm.

Adults and immatures of the order Diptera, including leafminers *Agromyza parvicornis* Loew (corn blotch leafminer); midges (including, but not limited to: *Contarinia sorghicola* Coquillett (sorghum midge); *Mayetiola destruc-*

*tor* Say (Hessian fly); *Sitodiplosis mosellana* Gehin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, F. femoral is Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophihus* spp.; *Oestrus* spp.; cattle grubs *Hypoderma* spp.; deer flies *Chrysops* spp.; *Melophagus ovinus* Linnaeus (keds) and other Brachycera, mosquitoes *Aedes* spp.; *Anopheles* spp.; *Culex* spp.; black flies *Prosinmlium* spp.; *Simulium* spp.; biting midges, sand flies, sciarids, and other Nematocera.

Adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); A. maidiradicis Forbes (corn root aphid); *A. pomi* De Geer (apple aphid); *A. spiraecola* Patch (spires aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach potato aphid, green peach aphid); *Nasonovia ribisnigri* Mosley (lettuce aphid); Pemphigus spp. (root aphids and gall aphids); *Rhopalosiphum maidis* Fitch (corn leaf aphid); *R. padi* Linnaeus (bird cherry-oat aphid); *Schizaphis graminum* Rondani (greenbug); Sipha (lava Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Melanaphis sacchari* (sugarcane aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); Dialeumdes *citri* Ashmead (citrus whitefly); *Trialeurodes* abutiloneus (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stal (rice leafhopper); *Nilaparvata lugens* Stal (brown planthopper); *Peregrinus maidis* Ashmead (corn planthopper); *Sogatella furcifera* Horvath (white backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear *psylla*); *Trioza diospyri* Ashmead (persimmon *psylla*).

Species from the order Hemiptera include, but are not limited to: *Acrosternum hilare* Say (green stink bug); *Anasa trisks* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servos* Say (brown stink bug); *E. variolarius* Palisot de Beauvais (one spotted stink bug); *Graptostethus* spp. (complex of seed bugs); *Leptoglossus corculus* Say (leaf footed pine seed bug); *Lygus lineolaris* Palisot de Beauvais (tarnished plant bug); *L. hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton flea hopper).

Hemiptera such as, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); Adelphocoris rapidus Say (rapid plant bug); *Poecilocapsus lineatus* Fabricius (four lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Adults and larvae of the order Acari (mites) such as *Aceria tosichella* Keifer (wheat curl mite); *Petrobia latens* Muller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order lxodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura, such as *Lepisma saccharina* Linnaeus (silverfish); *Thermobia domestica* Packard (firebrat).

Additional arthropod pests include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (*Bagrada* Bug)), the family Plataspidae (*Megacopta cribraria*-Bean plataspid) and the family Cydnidae (*Scaptocoris castanea*-Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hubner.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Pesticidal Compositions Comprising a Pesticide and Microbe of the Disclosure

As aforementioned, agricultural compositions of the disclosure, which may comprise any microbe taught herein, are sometimes combined with one or more pesticides. Pesticides can include herbicides, insecticides, fungicides, nematicides, etc.

In some embodiments, the pesticides/microbial combinations can be applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time release or biodegradable carrier formulations that permit long term dosing of a target area following a single application of the formulation. They can also be selective herbicides, chemical insecticides, virucides, microbicides, amoebicides, pesticides, fungicides, bacteriocides, nematicides, molluscicides or mixtures of several of these preparations, if desired, together with further agriculturally acceptable carriers, surfactants or application promoting adjuvants customarily employed in the art of formulation. Suitable carriers (i.e. agriculturally acceptable carriers) and adjuvants can be solid or liquid and correspond to the substances ordinarily employed in formulation technology, e.g. natural or regenerated mineral substances, solvents, dispersants, wetting agents, sticking agents, tackifiers, binders or fertilizers. Likewise, the formulations may be prepared into edible baits or fashioned into pest traps to permit feeding or ingestion by a target pest of the pesticidal formulation.

Exemplary chemical compositions, which may be combined with the microbes of the disclosure, include:

Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuringiensis*, Carbaryl, Carbofuran, Chlorpyrifos, Cypermethrin, Deltamethrin, Diazinon, Malathion, Abamectin, Cyfluthrin/betacyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin benzoate, Indoxacarb, Forthiazate, Fenamiphos, Cadusaphos, Pyriproxifen, Fenbutatin oxide, Hexthiazox, Methomyl, 4-[[(6-Chlorpyridin-3-yl)methyl](2, 2-difluorethyl)amino]furan-2(5H)-on; Fruits Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid;

Cereals Herbicides: lsoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, lodosulfuron, Propoxycarbazone, Picolin-afen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalothrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon methyl, Pirimicarb, Methiocarb;

Maize Herbicides: Atrazine, Alachlor, Bromoxynil, Acetochlor, Dicamba, Clopyralid, S-Dimethenamid, Glufosinate, Glyphosate, Isoxaflutole, S-Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirim-phos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin;

Rice Herbicides: Butachlor, Propanil, Azimsulfuron, Bensulfuron, Cyhalo-fop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitro-thion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofen-prox, Triazophos, 4-[[(6-Chlorpyridin-3-yl)methyl] (2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil;

Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl) methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene;

Soybean Herbicides: Alachlor, Bentazone, Trifluralin, Chlorimuron-Ethyl, Cloransulam-Methyl, Fenoxaprop, Fomesafen, Flu-azifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl] (2,2-difluorethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole;

Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepral-oxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl) methyl](2,2-difluor-ethyl)amino]furan-2(5H)-on, Tefluthrin, Rynaxypyr, Cyaxypyr, Fipronil, Carbofuran;

Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophos-phates, Pyrethroids, Thiacloprid, Deltamethrin, Imidacloprid, Clothianidin, Thiamethoxam, Acetamiprid, Dineto-furan, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl] (2,2-difluorethyl) amino] furan-2(5H)-on.

Insecticidal Compositions Comprising an Insecticide and Microbe of the Disclosure As aforementioned, agricultural compositions of the disclosure, which may comprise any microbe taught herein, are sometimes combined with one or more insecticides.

In some embodiments, insecticidal compositions may be included in the compositions set forth herein, and can be applied to a plant(s) or a part(s) thereof simultaneously or in succession, with other compounds. Insecticides include ammonium carbonate, aqueous potassium silicate, boric acid, copper sulfate, elemental sulfur, lime sulfur, sucrose octanoate esters, 4-[[(6-Chlorpyridin-3-yl)methyl](2, 2-difluorethyl)amino]furan-2(5H)-on, abamectin, notenone, fenazaquin, fenpyroximate, pyridaben, pyrimedifen, tebufenpyrad, tolfenpyrad, acephate, emamectin benzoate, lepimectin, milbemectin, hdroprene, kinoprene, methoprene, fenoxycarb, pyriproxyfen, methryl bromide and other alkyl halides, fulfuryl fluoride, chloropicrin, borax, disodium octaborate, sodium borate, sodium metaborate, tartar emetic, dazomet, metam, pymetrozine, pyrifluquinazon, flofentezine, diflovidazin, hexythiazox, bifenazate, thiamethoxam, imidacloprid, fenpyroximate, azadirachtin, permethrin, esfenvalerate, acetamiprid, bifenthrin, indoxacarb, azadirachtin, pyrethrin, imidacloprid, beta-cyfluthrin, sulfotep, tebupirimfos, temephos, terbufos, tetrachlorvinphos, thiometon, triazophos, alanycarb, aldicarb, bendiocarb, benfuracarb, butocarboxim, butoxycarboxim, carbaryl, carbofuran, carbosulfan, ethiofencarb, fenobucarb, formetanate, furathiocarb, isoprocarb, methiocarb, methymyl, metolcarb, oxamyl, primicarb, propoxur, thiodicarb, thiofanox, triazamate, trimethacarb, XMC, xylylcarb, acephate, azamethiphos, azinphos-ethyl, azinphos-methyl, cadusafos, chlorethoxyfox, trichlorfon, vamidothion, chlordane, endosulfan, ethiprole, fipronil, acrinathrin, allethrin, bifenthrin, bioallethrin, bioalletherin X-cyclopentenyl, bioresmethrin, cyclorothrin, cyfluthrin, cyhalothrin, cypermethrin, cyphenothrin [(1R)-trans-isomers], deltamethrin, empenthrin [(EZ)-(1R)-isomers], esfenvalerate, etofenprox, fenpropathrin, fenvalerate, flucythrinate, flumethrin, halfenprox, kadathrin, phenothrin [(1R)-trans-isomer] prallethrin, pyrethrins (pyrethrum), resmethrin, silafluofen, tefluthrin, tetramethrin, tetramethrin [(1R)-isomers], tralomethrin, transfluthrin, alpha-cypermethrin, beta-cyfluthrin, beta-cypermethrin, d-cis-trans allethrin, d-trans allethrin, gamma-cyhalothrin, lamda-cyhalothrin, tau-fluvalinate, theta-cypermethrin, zeta-cypermethrin, methoxychlor, nicotine, sulfoxaflor, acetamiprid, clothianidin, dinotefuran, imidacloprid, nitenpyram, thiacloprid, thiamethoxan, tebuprimphos, beta-cyfluthrin, clothianidin, flonicamid, hydramethylnon, amitraz, flubendiamide, blorantraniliprole, lambda cyhalothrin, spinosad, gamma cyhalothrin, *Beauveria bassiana, capsicum* oleoresin extract, garlic oil, carbaryl, chlorpyrifos, sulfoxaflor, lambda cyhalothrin, Chlorfenvinphos, Chlormephos, Chlorpyrifos, Chlorpyrifos-methyl, Coumaphos, Cyanophos, Demeton-S-methyl, Diazinon, Dichlorvosi DDVP, Dicrotophos, Dimethoate, Dimethylvinphos, Disulfoton, EPN, Ethion, Ethoprophos, Famphur, Fenamiphos, Fenitrothion, Fenthion, Fosthiazate, Heptenophos, Imicyafos, Isofenphos, Isopropyl O-(methoxyaminothio-phosphoryl) salicylate, Isoxathion, Malathion, Mecarbam, Methamidophos, Methidathion, Mevinphos, Monocrotophos, Naled, Omethoate, Oxydemeton-methyl, Parathion, Parathion-methyl, Phenthoate, Phorate, Phosalone, Phosmet, Phosphamidon, Phoxim, Pirimiphos-methyl, Profenofos, Propetamphos, Prothiofos, Pyraclofos, Pyridaphenthion, Quinalphosfluacrypyrim, tebufenozide, chlorantraniliprole, *Bacillus thuringiensis* subs. Kurstaki, terbufios, mineral oil, fenpropathrin, metaldehyde, deltamethrin, diazinon, dimethoate, diflubenzuron, pyriproxyfen, reosemary oil, peppermint oil, geraniol, azadirachtin, piperonyl butoxide, cyantraniliprole, alpha cypermethrin, tefluthrin, pymetrozine, malathion, *Bacillus thuringiensis* subsp. *israelensis*, dicofol, bromopropylate, benzoximate, azadirachtin, flonicamid, soybean oil, *Chromobacterium subtsugae* strain PRAA4-1, zeta cypermethrin, phosmet, methoxyfenozide, paraffinic oil, spirotetramat, methomyl, *Metarhizium anisopliae* strain F52, ethoprop, tetradifon, propargite, fenbutatin oxide, azocyclotin, cyhexatin, diafenthiuron, *Bacillus sphaericus*, etoxazole, flupyradifurone, azadirachtin, *Beauveria bassiana*, cyflumetofen, azadirachtin, chinomethionat, acephate, *Isaria fumosorosea* Apopka strain 97, sodium tetraborohydrate decahydrate, emamectin benzoate, cryolite, spinetoram, *Chenopodium ambrosioides* extract, novaluron, dinotefuran, carbaryl, acequinocyl, flupyradifurone, iron phosphate, kaolin, buprofezin, cyromazine, chromafenozide, halofenozide, methoxyfenozide, tebufenozide, bistrifluron, chlorfluazuron, diflubenzuron, flucycloxuron, flufenoxuron, hexaflumuron, lufenuron, nocaluron, noviflumuron, teflubenzuron, triflumuron, bensultap, cartap hydrochloride, thiocyclam, thiosultap-sodium, DNOC, chlorfenapyr, sulfuramid, phorate, tolfenpyrad, sulfoxaflor, neem oil, *Bacillus thuringiensis* subsp. *tenebrionis* strain SA-10, cyromazine, heat-killed *Burkholderia* spp., cyantraniliprole, cyenopyrafen, cyflumetofen, sodium cyanide, potassium cyanide, calcium cyanide, aluminum phosphide, calcium phosphide, phosphine, zinc phosphide, spriodiclofen, spiromesifen, spirotetramat, metaflumizone, flubendiamide, pyflubumide, oxamyl, *Bacillus thuringiensis* subsp. *aizawai*, etoxazole, and esfenvalerate

TABLE 9

Exemplary insecticides associated with various modes of action, which can be combined with micrbobes of the disclosure

| Mode of Action | Compound class | Exemplary insecticides | Physiological function(s) affected |
|---|---|---|---|
| acetylcholinesterase (AChE) inhibitors | carbamates | Alanycarb, Aldicarb, Bendiocarb, Benfuracarb, Butocarboxim, Butoxycarboxim, Carbaryl, Carbofuran, Carbosulfan, Ethiofencarb, Fenobucarb, Formetanate, Furathiocarb, Isoprocarb, Methiocarb, Methomyl, Metolcarb, Oxamyl, Pirimicarb, Propoxur, Thiodicarb, Thiofanox, Triazamate, Trimethacarb, XMC, Xylylcarb | Nerve and muscle |
| acetylcholinesterase (AChE) inhibitors | organophosphates | Acephate, Azamethiphos, Azinphos-ethyl, Azinphos-methyl, Cadusafos, Chlorethoxyfos, Chlorfenvinphos, Chlormephos, Chlorpyrifos, Chlorpyrifos-methyl, Coumaphos, Cyanophos, Demeton-S-methyl, Diazinon, Dichlorvos/DDVP, Dicrotophos, Dimethoate, Dimethylvinphos, Disulfoton, EPN, Ethion, Ethoprophos, Famphur, Fenamiphos, Fenitrothion, Fenthion, Fosthiazate, Heptenophos, Imicyafos, Isofenphos, Isopropyl O-(methoxyaminothio-phosphoryl) salicylate, Isoxathion, Malathion, Mecarbam, Methamidophos, Methidathion, Mevinphos, Monocrotophos, Naled, Omethoate, Oxydemeton-methyl, Parathion, Parathion-methyl, Phenthoate, Phorate, Phosalone, Phosmet, Phosphamidon, Phoxim, Pirimiphos-methyl, Profenofos, Propetamphos, Prothiofos, Pyraclofos, Pyridaphenthion, Quinalphos, Sulfotep, Tebupirimfos, Temephos, Terbufos, Tetrachlorvinphos, Thiometon, Triazophos, Trichlorfon, Vamidothion | Nerve and muscle |

TABLE 9-continued

Exemplary insecticides associated with various modes of action, which can be combined with micrbobes of the disclosure

| Mode of Action | Compound class | Exemplary insecticides | Physiological function(s) affected |
|---|---|---|---|
| GABA-gated chloride channel blockers | cyclodiene organochlorines | Chlordane, Endosulfan | Nerve and muscle |
| GABA-gated chloride channel blockers | phenylpyrazoles (Fiproles) | Ethiprole, Fipronil | Nerve and muscle |
| sodium channel modulators | pyrethroids, pyrethrins | Acrinathrin, Allethrin, Bifenthrin, Bioallethrin, Bioallethrin S-cyclopentenyl, Bioresmethrin, Cycloprothrin, Cyfluthrin, Cyhalothrin, Cypermethrin, Cyphenothrin [(1R)-trans- isomers], Deltamethrin, Empenthrin [(EZ)-(1R)- isomers], Esfenvalerate, Etofenprox, Fenpropathrin, Fenvalerate, Flucythrinate, Flumethrin, Halfenprox, Kadathrin, Phenothrin [(1R)-trans- isomer], Prallethrin, Pyrethrins (pyrethrum), Resmethrin, Silafluofen, Tefluthrin, Tetramethrin, Tetramethrin [(1R)- isomers], Tralomethrin, Transfluthrin, alpha-Cypermethrin, beta-Cyfluthrin, beta-Cypermethrin, d-cis-trans Allethrin, d-trans Allethrin, gamma-Cyhalothrin, lambda-Cyhalothrin, tau-Fluvalinate, theta-Cypermethrin, zeta-Cypermethrin | Nerve and muscle |
| sodium channel modulators | DDT, methoxychlor | DDT, methoxychlor | Nerve and muscle |
| nicotinic acetylcholine receptor (nAChR) competitive modulators | neonicotinoids | Acetamiprid, Clothianidin, Dinotefuran, Imidacloprid, Nitenpyram, Thiacloprid, Thiamethoxam | Nerve and muscle |
| nicotinic acetylcholine receptor (nAChR) competitive modulators | nicotine | nicotine | Nerve and muscle |
| nicotinic acetylcholine receptor (nAChR) competitive modulators | sulfoximines | sulfoxaflor | Nerve and muscle |
| nicotinic acetylcholine receptor (nAChR) competitive modulators | butenolides | Flupyradifurone | Nerve and muscle |
| nicotinic acetylcholine receptor (nAChR) allosteric modulators | spinosyns | Spinetoram, Spinosad | Nerve and muscle |
| Glutamate-gated chloride channel (GluCl) allosteric modulators | avermectins, milbemycins | Abamectin, Emamectin benzoate, Lepimectin, Milbemectin | Nerve and muscle |
| juvenile hormone mimics | juvenile hormone analogues | Hydroprene, Kinoprene, Methoprene | Growth |
| juvenile hormone mimics | Fenoxycarb | Fenoxycarb | Growth |
| juvenile hormone mimics | Pyriproxyfen | Pyriproxyfen | Growth |
| miscellaneous non-specific (multi-site) inhibitors | alkyl halides | Methyl bromide and other alkyl halides | Unknown or non-specific |
| miscellaneous non-specific (multi-site) inhibitors | Chloropicrin | Chloropicrin | Unknown or non-specific |
| miscellaneous non-specific (multi-site) inhibitors | fluorides | Cryolite, sulfuryl fluoride | Unknown or non-specific |

TABLE 9-continued

Exemplary insecticides associated with various modes of action, which can be combined with micrbobes of the disclosure

| Mode of Action | Compound class | Exemplary insecticides | Physiological function(s) affected |
|---|---|---|---|
| miscellaneous non-specific (multi-site) inhibitors | borates | Borax, Boric acid, Disodium octaborate, Sodium borate, Sodium metaborate | Unknown or non-specific |
| miscellaneous non-specific (multi-site) inhibitors | tartar emetic | tartar emetic | Unknown or non-specific |
| miscellaneous non-specific (multi-site) inhibitors | methyl isothiocyanate generators | Dazomet, Metam | Unknown or non-specific |
| modulators of chordotonal organs | Pyridine azomethine derivatives | Pymetrozine, Pyrifluquinazon | Nerve and muscle |
| mite growth inhibitors | Clofentezine, Diflovidazin, Hexythiazox | Clofentezine, Diflovidazin, Hexythiazox | Growth |
| mite growth inhibitors | Etoxazole | Etoxazole | Growth |
| microbial disruptors of insect midgut membranes | Bacillus thuringiensisand the insecticidal proteins they produce | Bt var. *aizawai*, Bt var. *israelensis*, Bt var. *kurstaki*, Bt var. *tenebrionensis* | Midgut |
| microbial disruptors of insect midgut membranes | *Bacillus sphaericus* | *Bacillus sphaericus* | Midgut |
| inhibitors of mitochondrial ATP synthase | Diafenthiuron | Diafenthiuron | Respiration |
| inhibitors of mitochondrial ATP synthase | organotin miticides | Azocyclotin, Cyhexatin, Fenbutatin oxide | Respiration |
| inhibitors of mitochondrial ATP synthase | Propargite | Propargite | Respiration |
| inhibitors of mitochondrial ATP synthase | Tetradifon | Tetradifon | Respiration |
| uncouplers of oxidative phosphorylation via disruption of the proton gradient | Chlorfenapyr, DNOC, Sulfuramid | Chlorfenapyr, DNOC, Sulfuramid | Respiration |
| Nicotinic acetylcholine receptor (nAChR) channel blockers | nereistoxin analogues | Bensultap, Cartap hydrochloride, Thiocyclam, Thiosultap-sodium | Nerve and muscle |
| inhibitors of chitin biosynthesis, type 0 | benzoylureas | Bistrifluron, Chlorfluazuron, Diflubenzuron, Flucycloxuron, Flufenoxuron, Hexaflumuron, Lufenuron, Novaluron, Noviflumuron, Teflubenzuron, Triflumuron | Growth |
| inhibitors of chitin biosynthesis, type 1 | Buprofezin | Buprofezin | Growth |
| moulting disruptor, Dipteran | Cyromazine | Cyromazine | Growth |
| ecdysone receptor agonists | diacylhydrazines | Chromafenozide, Halofenozide, Methoxyfenozide, Tebufenozide | Growth |
| octopamine receptor agonists | Amitraz | Amitraz | Nerve and muscle |
| mitochondrial complex III electron transport inhibitors | Hydramethylnon | Hydramethylnon | Respiration |
| mitochondrial complex III electron transport inhibitors | Acequinocyl | Acequinocyl | Respiration |
| mitochondrial complex III electron transport inhibitors | Fluacrypyrim | Fluacrypyrim | Respiration |
| mitochondrial complex III electron transport inhibitors | Bifenazate | Bifenazate | Respiration |

TABLE 9-continued

Exemplary insecticides associated with various modes of action, which can be combined with micrbobes of the disclosure

| Mode of Action | Compound class | Exemplary insecticides | Physiological function(s) affected |
|---|---|---|---|
| mitochondrial complex I electron transport inhibitors | Meti acaricides and insecticides | Fenazaquin, Fenpyroximate, Pyridaben, Pyrimidifen, Tebufenpyrad, Tolfenpyrad | Respiration |
| mitochondrial complex I electron transport inhibitors | Rotenone | Rotenone | Respiration |
| voltage-dependent sodium channel blockers | oxadiazines | Indoxacarb | Nerve and muscle |
| voltage-dependent sodium channel blockers | semicarbazones | Metaflumizone | Nerve and muscle |
| inhibitors of acetyl CoA carboxylase | tetronic and tetramic acid derivatives | Spirodiclofen, Spiromesifen, Spirotetramat | Growth |
| mitochondrial complex IV electron transport inhibitors | phosphides | Aluminium phosphide, Calcium phosphide, Phosphine, Zinc phosphide | Respiration |
| mitochondrial complex IV electron transport inhibitors | cyanides | Calcium cyanide, Potassium cyanide, Sodium cyanide | Respiration |
| mitochondrial complex II electron transport inhibitors | beta-ketonitrile | Cyenopyrafen, Cyflumetofen derivatives | Respiration |
| mitochondrial complex II electron transport inhibitors | carboxanilides | Pyflubumide | Respiration |
| ryanodine receptor modulators | diamides | Chlorantraniliprole, Cyantraniliprole, Flubendiamide | Nerve and muscle |
| Chordotonal organ modulators - undefined target site | Flonicamid | Flonicamid | Nerve and muscle |
| compounds of unknown or uncertain mode of action | Azadirachtin | Azadirachtin | Unknown |
| compounds of unknown or uncertain mode of action | Benzoximate | Benzoximate | Unknown |
| compounds of unknown or uncertain mode of action | Bromopropylate | Bromopropylate | Unknown |
| compounds of unknown or uncertain mode of action | Chinomethionat | Chinomethionat | Unknown |
| compounds of unknown or uncertain mode of action | Dicofol | Dicofol | Unknown |
| compounds of unknown or uncertain mode of action | lime sulfur | lime sulfur | Unknown |
| compounds of unknown or uncertain mode of action | Pyridalyl | Pyridalyl | Unknown |
| compounds of unknown or uncertain mode of action | sulfur | sulfur | Unknown |

TABLE 10

| Exemplary list of pesticides, which can be combined with microbes of the disclosure | |
|---|---|
| Category | Compounds |
| INSECTICIDES | |
| arsenical insecticides | calcium arsenate |
| | copper acetoarsenite |
| | copper arsenate |
| | lead arsenate |
| | potassium arsenite |
| | sodium arsenite |
| botanical insecticides | allicin |
| | anabasine |
| | azadirachtin |
| | carvacrol |
| | d-limonene |
| | matrine |
| | nicotine |
| | nornicotine |
| | oxymatrine |
| | pyrethrins |
| | cinerins |
| | cinerin I |
| | cinerin II |
| | jasmolin I |
| | jasmolin II |
| | pyrethrin I |
| | pyrethrin II |
| | quassia |
| | rhodojaponin-III |
| | rotenone |
| | ryania |
| | sabadilla |
| | sanguinarine |
| | triptolide |
| carbamate insecticides | bendiocarb |
| | carbaryl |
| benzofuranyl methylcarbamate insecticides | benfuracarb |
| | carbofuran |
| | carbosulfan |
| | decarbofuran |
| | furathiocarb |
| dimethylcarbamate insecticides | dimetan |
| | dimetilan |
| | hyquincarb |
| | isolan |
| | pirimicarb |
| | pyramat |
| | pyrolan |
| oxime carbamate insecticides | alanycarb |
| | aldicarb |
| | aldoxycarb |
| | butocarboxim |
| | butoxycarboxim |
| | methomyl |
| | nitrilacarb |
| | oxamyl |
| | tazimcarb |
| | thiocarboxime |
| | thiodicarb |
| | thiofanox |
| phenyl methylcarbamate insecticides | allyxycarb |
| | aminocarb |
| | bufencarb |
| | butacarb |
| | carbanolate |
| | cloethocarb |
| | CPMC |
| | dicresyl |
| | dimethacarb |
| | dioxacarb |
| | EMPC |
| | ethiofencarb |
| | fenethacarb |
| | fenobucarb |
| | isoprocarb |
| | methiocarb |
| | metolcarb |

TABLE 10-continued

| Exemplary list of pesticides, which can be combined with microbes of the disclosure | |
|---|---|
| Category | Compounds |
| | mexacarbate |
| | promacyl |
| | promecarb |
| | propoxur |
| | trimethacarb |
| | XMC |
| | xylylcarb |
| diamide insecticides | broflanilide |
| | chlorantraniliprole |
| | cyantraniliprole |
| | cyclaniliprole |
| | cyhalodiamide |
| | flubendiamide |
| | tetraniliprole |
| dinitrophenol insecticides | dinex |
| | dinoprop |
| | dinosam |
| | DNOC |
| fluorine insecticides | barium hexafluorosilicate |
| | cryolite |
| | flursulamid |
| | sodium fluoride |
| | sodium hexafluorosilicate |
| | sulfluramid |
| formamidine insecticides | amitraz |
| | chlordimeform |
| | formetanate |
| | formparanate |
| | medimeform |
| | semiamitraz |
| fumigant insecticides | acrylonitrile |
| | carbon disulfide |
| | carbon tetrachloride |
| | carbonyl sulfide |
| | chloroform |
| | chloropicrin |
| | cyanogen |
| | para-dichlorobenzene |
| | 1,2-dichloropropane |
| | dithioether |
| | ethyl formate |
| | ethylene dibromide |
| | ethylene dichloride |
| | ethylene oxide |
| | hydrogen cyanide |
| | methyl bromide |
| | methyl iodide |
| | methylchloroform |
| | methylene chloride |
| | naphthalene |
| | phosphine |
| | sodium tetrathiocarbonate |
| | sulfuryl fluoride |
| | tetrachloroethane |
| inorganic insecticides | borax |
| | boric acid |
| | calcium polysulfide |
| | copper oleate |
| | diatomaceous earth |
| | mercurous chloride |
| | potassium thiocyanate |
| | silica gel |
| | sodium thiocyanate |
| insect growth regulators | |
| chitin synthesis inhibitors | buprofezin |
| | cyromazine |
| benzoylphenylurea chitin synthesis inhibitors | bistrifluron |
| | chlorbenzuron |
| | chlorfluazuron |
| | dichlorbenzuron |
| | diflubenzuron |
| | flucycloxuron |
| | flufenoxuron |
| | hexaflumuron |

TABLE 10-continued

Exemplary list of pesticides, which can be combined with microbes of the disclosure

| Category | Compounds |
|---|---|
| | lufenuron |
| | novaluron |
| | noviflumuron |
| | penfluron |
| | teflubenzuron |
| | triflumuron |
| juvenile hormone mimics | dayoutong |
| | epofenonane |
| | fenoxycarb |
| | hydroprene |
| | kinoprene |
| | methoprene |
| | pyriproxyfen |
| | triprene |
| juvenile hormones | juvenile hormone I |
| | juvenile hormone II |
| | juvenile hormone III |
| moulting hormone agonists | chromafenozide |
| | furan tebufenozide |
| | halofenozide |
| | methoxyfenozide |
| | tebufenozide |
| | yishijing |
| moulting hormones | α-ecdysone |
| | ecdysterone |
| moulting inhibitors | diofenolan |
| precocenes | precocene I |
| | precocene II |
| | precocene III |
| unclassified insect growth regulators | dicyclanil |
| macrocyclic lactone insecticides | |
| avermectin insecticides | abamectin |
| | doramectin |
| | emamectin |
| | eprinomectin |
| | ivermectin |
| | selamectin |
| milbemycin insecticides | lepimectin |
| | milbemectin |
| | milbemycin oxime |
| | moxidectin |
| spinosyn insecticides | spinetoram |
| | spinosad |
| neonicotinoid insecticides | |
| nitroguanidine neonicotinoid insecticides | clothianidin |
| | dinotefuran |
| | imidacloprid |
| | imidaclothiz |
| | thiamethoxam |
| nitromethylene neonicotinoid insecticides | nitenpyram |
| | nithiazine |
| pyridylmethylamine neonicotinoid insecticides | acetamiprid |
| | imidacloprid |
| | nitenpyram |
| | paichongding |
| | thiacloprid |
| nereistoxin analogue insecticides | bensultap |
| | cartap |
| | polythialan |
| | thiocyclam |
| | thiosultap |
| organochlorine insecticides | bromo-DDT |
| | camphechlor |
| | DDT |
| | pp'-DDT |
| | ethyl-DDD |
| | HCH |
| | gamma-HCH |
| | lindane |
| | methoxychlor |
| | pentachlorophenol |
| | TDE |
| cyclodiene insecticides | aldrin |
| | bromocyclen |
| | chlorbicyclen |
| | chlordane |
| | chlordecone |
| | dieldrin |
| | dilor |
| | endosulfan |
| | alpha-endosulfan |
| | endrin |
| | HEOD |
| | heptachlor |
| | HHDN |
| | isobenzan |
| | isodrin |
| | kelevan |
| | mirex |
| organophosphorus insecticides | |
| organophosphate insecticides | bromfenvinfos |
| | calvinphos |
| | chlorfenvinphos |
| | crotoxyphos |
| | dichlorvos |
| | dicrotophos |
| | dimethylvinphos |
| | fospirate |
| | heptenophos |
| | methocrotophos |
| | mevinphos |
| | monocrotophos |
| | naled |
| | naftalofos |
| | phosphamidon |
| | propaphos |
| | TEPP |
| | tetrachlorvinphos |
| organothiophosphate insecticides | dioxabenzofos |
| | fosmethilan |
| | phenthoate |
| aliphatic organothiophosphate insecticides | acethion |
| | acetophos |
| | amiton |
| | cadusafos |
| | chlorethoxyfos |
| | chlormephos |
| | demephion |
| | demephion-O |
| | demephion-S |
| | demeton |
| | demeton-O |
| | demeton-S |
| | demeton-methyl |
| | demeton-O-methyl |
| | demeton-S-methyl |
| | demeton-S-methylsulphon |
| | disulfoton |
| | ethion |
| | ethoprophos |
| | IPSP |
| | isothioate |
| | malathion |
| | methacrifos |
| | methylacetophos |
| | oxydemeton-methyl |
| | oxydeprofos |
| | oxydisulfoton |
| | phorate |
| | sulfotep |
| | terbufos |
| | thiometon |
| aliphatic amide organothiophosphate insecticides | amidithion |
| | cyanthoate |
| | dimethoate |
| | ethoate-methyl |

TABLE 10-continued

Exemplary list of pesticides, which can be combined with microbes of the disclosure

| Category | Compounds |
|---|---|
| | formothion |
| | mecarbam |
| | omethoate |
| | prothoate |
| | sophamide |
| | vamidothion |
| oxime organothiophosphate insecticides | chlorphoxim |
| | phoxim |
| | phoxim-methyl |
| heterocyclic organothiophosphate insecticides | azamethiphos |
| | colophonate |
| | coumaphos |
| | coumithoate |
| | dioxathion |
| | endothion |
| | menazon |
| | morphothion |
| | phosalone |
| | pyraclofos |
| | pyrazothion |
| | pyridaphenthion |
| | quinothion |
| benzothiopyran organothiophosphate insecticides | dithicrofos |
| | thicrofos |
| benzotriazine organothiophosphate insecticides | azinphos-ethyl |
| | azinphos-methyl |
| isoindole organothiophosphate insecticides | dialifos |
| | phosmet |
| isoxazole organothiophosphate insecticides | isoxathion |
| | zolaprofos |
| pyrazolopyrimidine organothiophosphate insecticides | chlorprazophos |
| | pyrazophos |
| pyridine organothiophosphate insecticides | chlorpyrifos |
| | chlorpyrifos-methyl |
| pyrimidine organothiophosphate insecticides | butathiofos |
| | diazinon |
| | etrimfos |
| | lirimfos |
| | pirimioxyphos |
| | pirimiphos-ethyl |
| | pirimiphos-methyl |
| | primidophos |
| | pyrimitate |
| | tebupirimfos |
| quinoxaline organothiophosphate insecticides | quinalphos |
| | quinalphos-methyl |
| thiadiazole organothiophosphate insecticides | athidathion |
| | lythidathion |
| | methidathion |
| | prothidathion |
| triazole organothiophosphate insecticides | isazofos |
| | triazophos |
| phenyl organothiophosphate insecticides | azothoate |
| | bromophos |
| | bromophos-ethyl |
| | carbophenothion |
| | chlorthiophos |
| | cyanophos |
| | cythioate |
| | dicapthon |
| | dichlofenthion |
| | etaphos |
| | famphur |
| | fenchlorphos |
| | fenitrothion |
| | fensulfothion |
| | fenthion |
| | fenthion-ethyl |
| | heterophos |
| | jodfenphos |
| | mesulfenfos |
| | parathion |
| | parathion-methyl |
| | phenkapton |
| | phosnichlor |

TABLE 10-continued

Exemplary list of pesticides, which can be combined with microbes of the disclosure

| Category | Compounds |
|---|---|
| | profenofos |
| | prothiofos |
| | sulprofos |
| | temephos |
| | trichlormetaphos-3 |
| | trifenofos |
| | xiaochongliulin |
| phosphonate insecticides | butonate |
| | trichlorfon |
| phosphonothioate insecticides | mecarphon |
| phenyl ethylphosphonothioate insecticides | fonofos |
| | trichloronat |
| phenyl phenylphosphonothioate insecticides | cyanofenphos |
| | EPN |
| | leptophos |
| phosphoramidate insecticides | crufomate |
| | fenamiphos |
| | fosthietan |
| | mephosfolan |
| | phosfolan |
| | phosfolan-methyl |
| | pirimetaphos |
| phosphoramidothioate insecticides | acephate |
| | chloramine phosphorus |
| | isocarbophos |
| | isofenphos |
| | isofenphos-methyl |
| | methamidophos |
| | phosglycin |
| | propetamphos |
| phosphorodiamide insecticides | dimefox |
| | mazidox |
| | mipafox |
| | schradan |
| oxadiazine insecticides | indoxacarb |
| oxadiazolone insecticides | metoxadiazone |
| phthalimide insecticides | dialifos |
| | phosmet |
| | tetramethrin |
| physical insecticides | maltodextrin |
| desiccant insecticides | boric acid |
| | diatomaceous earth |
| | silica gel |
| pyrazole insecticides | chlorantraniliprole |
| | cyantraniliprole |
| | cyclaniliprole |
| | dimetilan |
| | isolan |
| | tebufenpyrad |
| | tetraniliprole |
| | tolfenpyrad |
| phenylpyrazole insecticides | acetoprole |
| | ethiprole |
| | fipronil |
| | flufiprole |
| | pyraclofos |
| | pyrafluprole |
| | pyriprole |
| | pyrolan |
| | vaniliprole |
| pyrethroid insecticides | |
| pyrethroid ester insecticides | acrinathrin |
| | allethrin |
| | bioallethrin |
| | esdépalléthrine |
| | barthrin |
| | bifenthrin |
| | kappa-bifenthrin |
| | bioethanomethrin |
| | brofenvalerate |
| | brofluthrinate |
| | bromethrin |
| | butethrin |
| | chlorempenthrin |

TABLE 10-continued

Exemplary list of pesticides, which can be combined with microbes of the disclosure

| Category | Compounds |
|---|---|
| | cyclethrin |
| | cycloprothrin |
| | cyfluthrin |
| | beta-cyfluthrin |
| | cyhalothrin |
| | gamma-cyhalothrin |
| | lambda-cyhalothrin |
| | cypermethrin |
| | alpha-cypermethrin |
| | beta-cypermethrin |
| | theta-cypermethrin |
| | zeta-cypermethrin |
| | cyphenothrin |
| | deltamethrin |
| | dimefluthrin |
| | dimethrin |
| | empenthrin |
| | d-fanshiluquebingjuzhi |
| | chloroprallethrin |
| | fenfluthrin |
| | fenpirithrin |
| | fenpropathrin |
| | fenvalerate |
| | esfenvalerate |
| | flucythrinate |
| | fluvalinate |
| | tau-fluvalinate |
| | furamethrin |
| | furethrin |
| | heptafluthrin |
| | imiprothrin |
| | japothrins |
| | kadethrin |
| | methothrin |
| | metofluthrin |
| | epsilon-metofluthrin |
| | momfluorothrin |
| | epsilon-momfluorothrin |
| | pentmethrin |
| | permethrin |
| | biopermethrin |
| | transpermethrin |
| | phenothrin |
| | prallethrin |
| | profluthrin |
| | proparthrin |
| | pyresmethrin |
| | renofluthrin |
| | meperfluthrin |
| | resmethrin |
| | bioresmethrin |
| | cismethrin |
| | tefluthrin |
| | kappa-tefluthrin |
| | terallethrin |
| | tetramethrin |
| | tetramethylfluthrin |
| | tralocythrin |
| | tralomethrin |
| | transfluthrin |
| | valerate |
| pyrethroid ether insecticides | etofenprox |
| | flufenprox |
| | halfenprox |
| | protrifenbute |
| | silafluofen |
| pyrethroid oxime insecticides | sulfoxime |
| | thiofluoximate |
| pyrimidinamine insecticides | flufenerim |
| | pyrimidifen |
| pyrrole insecticides | chlorfenapyr |
| quaternary ammonium insecticides | sanguinarine |
| sulfoximine insecticides | sulfoxaflor |
| tetramic acid insecticides | spirotetramat |

TABLE 10-continued

Exemplary list of pesticides, which can be combined with microbes of the disclosure

| Category | Compounds |
|---|---|
| tetronic acid insecticides | spiromesifen |
| thiazole insecticides | clothianidin |
| | imidaclothiz |
| | thiamethoxam |
| | thiapronil |
| thiazolidine insecticides | tazimcarb |
| | thiacloprid |
| thiourea insecticides | diafenthiuron |
| urea insecticides | flucofuron |
| | sulcofuron |
| zwitterionic insecticides | dicloromezotiaz |
| | triflumezopyrim |
| unclassified insecticides | afidopyropen |
| | afoxolaner |
| | allosamidin |
| | closantel |
| | copper naphthenate |
| | crotamiton |
| | EXD |
| | fenazaflor |
| | fenoxacrim |
| | flometoquin |
| | flonicamid |
| | fluhexafon |
| | flupyradifurone |
| | fluralaner |
| | fluxametamide |
| | hydramethylnon |
| | isoprothiolane |
| | jiahuangchongzong |
| | malonoben |
| | metaflumizone |
| | nifluridide |
| | plifenate |
| | pyridaben |
| | pyridalyl |
| | pyrifluquinazon |
| | rafoxanide |
| | thuringiensin |
| | triarathene |
| | triazamate |
| ACARICIDES | |
| botanical acaricides | carvacrol |
| | sanguinarine |
| bridged diphenyl acaricides | azobenzene |
| | benzoximate |
| | benzyl benzoate |
| | bromopropylate |
| | chlorbenside |
| | chlorfenethol |
| | chlorfenson |
| | chlorfensulphide |
| | chlorobenzilate |
| | chloropropylate |
| | cyflumetofen |
| | DDT |
| | dicofol |
| | diphenyl sulfone |
| | dofenapyn |
| | fenson |
| | fentrifanil |
| | fluorbenside |
| | genit |
| | hexachlorophene |
| | phenproxide |
| | proclonol |
| | tetradifon |
| | tetrasul |
| carbamate acaricides | benomyl |
| | carbanolate |
| | carbaryl |
| | carbofuran |
| | methiocarb |
| | metolcarb |

TABLE 10-continued

Exemplary list of pesticides, which can be combined with microbes of the disclosure

| Category | Compounds |
|---|---|
| | promacyl |
| | propoxur |
| oxime carbamate acaricides | aldicarb |
| | butocarboxim |
| | oxamyl |
| | thiocarboxime |
| | thiofanox |
| carbazate acaricides | bifenazate |
| dinitrophenol acaricides | binapacryl |
| | dinex |
| | dinobuton |
| | dinocap |
| | dinocap-4 |
| | dinocap-6 |
| | dinocton |
| | dinopenton |
| | dinosulfon |
| | dinoterbon |
| | DNOC |
| formamidine acaricides | amitraz |
| | chlordimeform |
| | chloromebuform |
| | formetanate |
| | formparanate |
| | medimeform |
| | semi amitraz |
| macrocyclic lactone acaricides | tetranactin |
| avermectin acaricides | abamectin |
| | doramectin |
| | eprinomectin |
| | ivermectin |
| | selamectin |
| milbemycin acaricides | milbemectin |
| | milbemycin oxime |
| | moxidectin |
| mite growth regulators | clofentezine |
| | cyromazine |
| | diflovidazin |
| | dofenapyn |
| | fluazuron |
| | flubenzimine |
| | flucycloxuron |
| | flufenoxuron |
| | hexythiazox |
| organochlorine acaricides | bromocyclen |
| | camphechlor |
| | DDT |
| | dienochlor |
| | endosulfan |
| | lindane |
| organophosphorus acaricides | |
| organophosphate acaricides | chlorfenvinphos |
| | crotoxyphos |
| | dichlorvos |
| | heptenophos |
| | mevinphos |
| | monocrotophos |
| | naled |
| | TEPP |
| | tetrachlorvinphos |
| organothiophosphate acaricides | amidithion |
| | amiton |
| | azinphos-ethyl |
| | azinphos-methyl |
| | azothoate |
| | benoxafos |
| | bromophos |
| | bromophos-ethyl |
| | carbophenothion |
| | chlorpyrifos |
| | chlorthiophos |
| | coumaphos |
| | cyanthoate |
| | demeton |

TABLE 10-continued

Exemplary list of pesticides, which can be combined with microbes of the disclosure

| Category | Compounds |
|---|---|
| | demeton-O |
| | demeton-S |
| | demeton-methyl |
| | demeton-O-methyl |
| | demeton-S-methyl |
| | demeton-S-methylsulphon |
| | dialifos |
| | diazinon |
| | dimethoate |
| | dioxathion |
| | disulfoton |
| | endothion |
| | ethion |
| | ethoate-methyl |
| | formothion |
| | malathion |
| | mecarbam |
| | methacrifos |
| | omethoate |
| | oxydeprofos |
| | oxydisulfoton |
| | parathion |
| | phenkapton |
| | phorate |
| | phosalone |
| | phosmet |
| | phostin |
| | phoxim |
| | pirimiphos-methyl |
| | prothidathion |
| | prothoate |
| | pyrimitate |
| | quinalphos |
| | quintiofos |
| | sophamide |
| | sulfotep |
| | thiometon |
| | triazophos |
| | trifenofos |
| | vamidothion |
| phosphonate acaricides | trichlorfon |
| phosphoramidothioate acaricides | isocarbophos |
| | methamidophos |
| | propetamphos |
| phosphorodiamide acaricides | dimefox |
| | mipafox |
| | schradan |
| organotin acaricides | azocyclotin |
| | cyhexatin |
| | fenbutatin oxide |
| | phostin |
| phenylsulfamide acaricides | dichlofluanid |
| phthalimide acaricides | dialifos |
| | phosmet |
| pyrazole acaricides | cyenopyrafen |
| | fenpyroximate |
| | pyflubumide |
| | tebufenpyrad |
| phenylpyrazole acaricides | acetoprole |
| | fipronil |
| | vaniliprole |
| pyrethroid acaricides | |
| pyrethroid ester acaricides | acrinathrin |
| | bifenthrin |
| | brofluthrinate |
| | cyhalothrin |
| | cypermethrin |
| | alpha-cypermethrin |
| | fenpropathrin |
| | fenvalerate |
| | flucythrinate |
| | flumethrin |
| | fluvalinate |

TABLE 10-continued

| Exemplary list of pesticides, which can be combined with microbes of the disclosure | |
|---|---|
| Category | Compounds |
| | tau-fluvalinate |
| | permethrin |
| pyrethroid ether acaricides | halfenprox |
| pyrimidinamine acaricides | pyrimidifen |
| pyrrole acaricides | chlorfenapyr |
| quaternary ammonium acaricides | sanguinarine |
| quinoxaline acaricides | chinomethionat |
| | thioquinox |
| strobilurin acaricides | |
| methoxyacrylate strobilurin acaricides | bifujunzhi |
| | fluacrypyrim |
| | flufenoxystrobin |
| | pyriminostrobin |
| sulfite ester acaricides | aramite |
| | propargite |
| tetronic acid acaricides | spirodiclofen |
| tetrazine acaricides | clofentezine |
| | diflovidazin |
| thiazolidine acaricides | flubenzimine |
| | hexythiazox |
| thiocarbamate acaricides | fenothiocarb |
| thiourea acaricides | chloromethiuron |
| | diafenthiuron |
| unclassified acaricides | acequinocyl |
| | afoxolaner |
| | amidoflumet |
| | arsenous oxide |
| | clenpirin |
| | closantel |
| | crotamiton |
| | cycloprate |
| | cymiazole |
| | disulfiram |
| | etoxazole |
| | fenazaflor |
| | fenazaquin |
| | fluenetil |
| | fluralaner |
| | mesulfen |
| | MNAF |
| | nifluridide |
| | nikkomycins |
| | pyridaben |
| | sulfiram |
| | sulfluramid |
| | sulfur |
| | thuringiensin |
| | triarathene |
| CHEMOSTERILANTS | |
| | apholate |
| | bisazir |
| | busulfan |
| | diflubenzuron |
| | dimatif |
| | hemel |
| | hempa |
| | metepa |
| | methiotepa |
| | methyl apholate |
| | morzid |
| | penfluron |
| | tepa |
| | thiohempa |
| | thiotepa |
| | tretamine |
| | uredepa |
| INSECT REPELLENTS | |
| | acrep |
| | butopyronoxyl |
| | camphor |
| | d-camphor |
| | carboxide |

TABLE 10-continued

| Exemplary list of pesticides, which can be combined with microbes of the disclosure | |
|---|---|
| Category | Compounds |
| | dibutyl phthalate |
| | diethyltoluamide |
| | dimethyl carbate |
| | dimethyl phthalate |
| | dibutyl succinate |
| | ethohexadiol |
| | hexamide |
| | icaridin |
| | methoquin-butyl |
| | methylneodecanamide |
| | 2-(octylthio)ethanol |
| | oxamate |
| | quwenzhi |
| | quyingding |
| | rebemide |
| | zengxiaoan |
| NEMATICIDES | |
| avermectin nematicides | abamectin |
| botanical nematicides | carvacrol |
| carbamate nematicides | benomyl |
| | carbofuran |
| | carbosulfan |
| | cloethocarb |
| oxime carbamate nematicides | alanycarb |
| | aldicarb |
| | aldoxycarb |
| | oxamyl |
| | tirpate |
| fumigant nematicides | carbon disulfide |
| | cyanogen |
| | 1,2-dichloropropane |
| | 1,3-dichloropropene |
| | dithioether |
| | methyl bromide |
| | methyl iodide |
| | sodium tetrathiocarbonate |
| organophosphorus nematicides | |
| organophosphate nematicides | diamidafos |
| | fenamiphos |
| | fosthietan |
| | phosphamidon |
| organothiophosphate nematicides | cadusafos |
| | chlorpyrifos |
| | dichlofenthion |
| | dimethoate |
| | ethoprophos |
| | fensulfothion |
| | fosthiazate |
| | heterophos |
| | isamidofos |
| | isazofos |
| | phorate |
| | phosphocarb |
| | terbufos |
| | thionazin |
| | triazophos |
| phosphonothioate nematicides | imicyafos |
| | mecarphon |
| unclassified nematicides | acetoprole |
| | benclothiaz |
| | chloropicrin |
| | dazomet |
| | DBCP |
| | DCIP |
| | fluazaindolizine |
| | fluensulfone |
| | furfural |
| | metam |
| | methyl isothiocyanate |
| | tioxazafen |
| | xylenols |

Insecticides also include synergists or activators that are not in themselves considered toxic or insecticidal, but are materials used with insecticides to synergize or enhance the activity of the insecticides. Synergists or activators include piperonyl butoxide.

Biorational Pesticides

Insecticides can be biorational, or can also be known as biopesticides or biological pesticides. Biorational refers to any substance of natural origin (or man-made substances resembling those of natural origin) that has a detrimental or lethal effect on specific target pest(s), e.g., insects, weeds, plant diseases (including nematodes), and vertebrate pests, possess a unique mode of action, are non-toxic to man, domestic plants and animals, and have little or no adverse effects on wildlife and the environment.

Biorational insecticides (or biopesticides or biological pesticides) can be grouped as: (1) biochemicals (hormones, enzymes, pheromones and natural agents, such as insect and plant growth regulators), (2) microbial (viruses, bacteria, fungi, protozoa, and nematodes), or (3) Plant-Incorporated protectants (PIPs)—primarily transgenic plants, e.g., Bt corn.

Biopesticides, or biological pesticides, can broadly include agents manufactured from living microorganisms or a natural product and sold for the control of plant pests. Biopesticides can be: microorganisms, biochemicals, and semiochemicals. Biopesticides can also include peptides, proteins and nucleic acids such as double-stranded DNA, single-stranded DNA, double-stranded RNA, single-stranded RNA and hairpin DNA or RNA.

Bacteria, fungi, oomycetes, viruses and protozoa are all used for the biological control of insect pests. The most widely used microbial biopesticide is the insect pathogenic bacteria *Bacillus thuringiensis* (Bt), which produces a protein crystal (the Bt S-endotoxin) during bacterial spore formation that is capable of causing lysis of gut cells when consumed by susceptible insects. Microbial Bt biopesticides consist of bacterial spores and 5-endotoxin crystals mass-produced in fermentation tanks and formulated as a sprayable product. Bt does not harm vertebrates and is safe to people, beneficial organisms and the environment. Thus, Bt sprays are a growing tactic for pest management on fruit and vegetable crops where their high level of selectivity and safety are considered desirable, and where resistance to synthetic chemical insecticides is a problem. Bt sprays have also been used on commodity crops such as maize, soybean and cotton, but with the advent of genetic modification of plants, farmers are increasingly growing Bt transgenic crop varieties.

Other microbial insecticides include products based on entomopathogenic baculoviruses. Baculoviruses that are pathogenic to arthropods belong to the virus family and possess large circular, covalently closed, and double-stranded DNA genomes that are packaged into nucleocapsids. More than 700 baculoviruses have been identified from insects of the orders Lepidoptera, Hymenoptera, and Diptera. Baculoviruses are usually highly specific to their host insects and thus, are safe to the environment, humans, other plants, and beneficial organisms. Over 50 baculovirus products have been used to control different insect pests worldwide. In the US and Europe, the *Cydia pomonella* granulovirus (CpGV) is used as an inundative biopesticide against codlingmoth on apples. Washington State, as the biggest apple producer in the US, uses CpGV on 13% of the apple crop. In Brazil, the nucleopolyhedrovirus of the soybean caterpillar *Anticarsia gemmatalis* was used on up to 4 million ha (approximately 35%) of the soybean crop in the mid-1990s. Viruses such as Gemstar® (Certis USA) are available to control larvae of *Heliothis* and *Helicoverpa* species.

At least 170 different biopesticide products based on entomopathogenic fungi have been developed for use against at least five insect and acarine orders in glasshouse crops, fruit and field vegetables as well as commodity crops. The majority of products are based on the ascomycetes *Beauveria hassiana* or *Metarhizium anisopliae. M. anisopliae* has also been developed for the control of locust and grasshopper pests in Africa and Australia and is recommended by the Food and Agriculture Organization of the United Nations (FAO) for locust management.

A number of microbial pesticides registered in the United States are listed in Table 16 of Kabaluk et al. 2010 (Kabaluk, J. T. et al. (ed.). 2010. The Use and Regulation of Microbial Pesticides in Representative Jurisdictions Worldwide. IOBC Global. 99 pp.) and microbial pesticides registered in selected countries are listed in Annex 4 of Hoeschle-Zeledon et al. 2013 (Hoeschle-Zeledon, I., P. Neuenschwander and L. Kumar. (2013). Regulatory Challenges for biological control. SP-IPM Secretariat, International Institute of Tropical Agriculture (IITA), Ibadan, Nigeria. 43 pp.), each of which is incorporated herein in its entirety.

Plants produce a wide variety of secondary metabolites that deter herbivores from feeding on them. Some of these can be used as biopesticides. They include, for example, pyrethrins, which are fast-acting insecticidal compounds produced by *Chrysanthemum cinerariaefolium*. They have low mammalian toxicity but degrade rapidly after application. This short persistence prompted the development of synthetic pyrethrins (pyrethroids). The most widely used botanical compound is neem oil, an insecticidal chemical extracted from seeds of Azadirachta indica. Two highly active pesticides are available based on secondary metabolites synthesized by soil actinomycetes, but they have been evaluated by regulatory authorities as if they were synthetic chemical pesticides. Spinosad is a mixture of two macrolide compounds from *Saccharopolyspora spinosa*. It has a very low mammalian toxicity and residues degrade rapidly in the field. Farmers and growers used it widely following its introduction in 1997 but resistance has already developed in some important pests such as western flower *thrips*. Abamectin is a macrocyclic lactone compound produced by *Streptomyces avermitilis*. It is active against a range of pest species but resistance has developed to it also, for example, in tetranychid mites.

Peptides and proteins from a number of organisms have been found to possess pesticidal properties. Perhaps most prominent are peptides from spider venom (King, G. F. and Hardy, M. C. (2013) Spider-venom peptides: structure, pharmacology, and potential for control of insect pests. Annu. Rev. Entomol. 58: 475-496). A unique arrangement of disulfide bonds in spider venom peptides render them extremely resistant to proteases. As a result, these peptides are highly stable in the insect gut and hemolymph and many of them are orally active. The peptides target a wide range of receptors and ion channels in the insect nervous system. Other examples of insecticidal peptides include: sea anemone venom that act on voltage-gated Na+ channels (Bosmans, F. and Tytgat, J. (2007) Sea anemone venom as a source of insecticidal peptides acting on voltage-gated Na+ channels. Toxicon. 49(4): 550-560); the PA1b (Pea Albumin 1, subunit b) peptide from Legume seeds with lethal activity on several insect pests, such as mosquitoes, some aphids and cereal weevils (Eyraud, V. et al. (2013) Expression and Biological Activity of the Cystine Knot Bioinsecticide PA1 b (Pea Albumin 1 Subunit b). PLoS ONE 8(12): e81619); and an internal 10 kDa peptide generated by enzymatic hydrolysis of *Canavalia ensiformis* (jack bean) urease within susceptible insects (Martinelli, A. H. S., et al. (2014) Structure-function studies on jaburetox, a recombinant insecticidal peptide derived from jack bean (*Canavalia ensiformis*) urease. Biochimica et Biophysica Acta 1840: 935-944). Examples of commercially available peptide insecticides include Spear™-T for the treatment of *thrips* in vegetables and ornamentals in greenhouses, Spear™-P to control the Colorado Potato Beetle, and Spear™-C to protect crops from lepidopteran pests (Vestaron Corporation, Kalamazoo, Mich.). A novel insecticidal protein from *Bacillus bombysepticus*, called parasporal crystal toxin (PC), shows oral pathogenic activity and lethality towards silkworms and Cry1Ac-resistant *Helicoverpa armigera* strains (Lin, P. et al. (2015) PC, a novel oral insecticidal toxin from *Bacillus bombysepticus* involved in host lethality via APN and BtR-175. Sci. Rep. 5: 11101).

A semiochemical is a chemical signal produced by one organism that causes a behavioral change in an individual of the same or a different species. The most widely used semiochemicals for crop protection are insect sex pheromones, some of which can now be synthesized and are used for monitoring or pest control by mass trapping, lure-and-kill systems and mating disruption. Worldwide, mating disruption is used on over 660,000 ha and has been particularly useful in orchard crops.

As used herein, "transgenic insecticidal trait" refers to a trait exhibited by a plant that has been genetically engineered to express a nucleic acid or polypeptide that is detrimental to one or more pests. In one embodiment, the plants of the present disclosure are resistant to attach and/or infestation from any one or more of the pests of the present disclosure. In one embodiment, the trait comprises the expression of vegetative insecticidal proteins (VIPs) from *Bacillus thuringiensis*, lectins and proteinase inhibitors from plants, terpenoids, cholesterol oxidases from *Streptomyces* spp., insect chitinases and fungal chitinolytic enzymes, bacterial insecticidal proteins and early recognition resistance genes. In another embodiment, the trait comprises the expression of a *Bacillus thuringiensis* protein that is toxic to a pest. In one embodiment, the Bt protein is a Cry protein (crystal protein). Bt crops include Bt corn, Bt cotton and Bt soy. Bt toxins can be from the Cry family (see, for example, Crickmore et al., 1998, Microbiol. Mol. Biol. Rev. 62: 807-812), which are particularly effective against Lepidoptera, Coleoptera and Diptera.

Bt Cry and Cyt toxins belong to a class of bacterial toxins known as pore-forming toxins (PFT) that are secreted as water-soluble proteins undergoing conformational changes in order to insert into, or to translocate across, cell membranes of their host. There are two main groups of PFT: (i) the α-helical toxins, in which α-helix regions form the trans-membrane pore, and (ii) the β-barrel toxins, that insert into the membrane by forming a β-barrel composed of βsheet hairpins from each monomer. See, Parker M W, Feil S C, "Pore-forming protein toxins: from structure to function," Prog. Biophys. Mol. Biol. 2005 May; 88(1):91-142. The first class of PFT includes toxins such as the colicins, exotoxin A, diphtheria toxin and also the Cry three-domain toxins. On the other hand, aerolysin, α-hemolysin, anthrax protective antigen, cholesterol-dependent toxins as the perfringolysin O and the Cyt toxins belong to the 0-barrel toxins. Id. In general, PFT producing-bacteria secrete their toxins and these toxins interact with specific receptors located on the host cell surface. In most cases, PFT are activated by host proteases after receptor binding inducing the formation of an oligomeric structure that is insertion competent. Finally, membrane insertion is triggered, in most cases, by a decrease in pH that induces a molten globule state of the protein. Id.

The development of transgenic crops that produce Bt Cry proteins has allowed the substitution of chemical insecticides by environmentally friendly alternatives. In transgenic plants, the Cry toxin is produced continuously, protecting the toxin from degradation and making it reachable to chewing and boring insects. Cry protein production in plants has been improved by engineering cry genes with a plant biased codon usage, by removal of putative splicing signal sequences and deletion of the carboxy-terminal region of the protoxin. See, Schuler T H, et al., "Insect-resistant transgenic plants," Trends Biotechnol. 1998; 16:168-175. The use of insect resistant crops has diminished considerably the use of chemical pesticides in areas where these transgenic crops are planted. See, Qaim M, Zilbennan D, "Yield effects of genetically modified crops in developing countries," Science. 2003 Feb. 7; 299(5608):900-2.

Known Cry proteins include: 6-endotoxins including but not limited to: the Cry1, Cry2, Cry3, Cry4, Cry5, Cry6, Cry7, Cry8, Cry9, Cry10, Cry1, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry52, Cry 53, Cry 54, Cry55, Cry56, Cry57, Cry58, Cry59. Cry60, Cry61, Cry62, Cry63, Cry64, Cry65, Cry66, Cry67, Cry68, Cry69, Cry70 and Cry7l classes of S-endotoxin genes and the *B. thuringiensis* cytolytic cyt1 and cyt2 genes.

Members of these classes of *B. thuringiensis* insecticidal proteins include, but are not limited to: Cry1Aa1 (Accession #AAA22353); Cry1Aa2 (Accession #Accession #AAA22552); Cry1Aa3 (Accession #BAA00257); Cry1Aa4 (Accession #CAA31886); Cry1Aa5 (Accession #BAA04468); Cry1Aa6 (Accession #AAA86265); Cry1Aa7 (Accession #AAD46139); Cry1Aa8 (Accession #126149); Cry1Aa9 (Accession #BAA77213); Cry1Aa10 (Accession #AAD55382); Cry1Aa11 (Accession #CAA70856); Cry1Aa12 (Accession #AAP80146); Cry1Aa13 (Accession #AAM44305); Cry1Aa14 (Accession #AAP40639); Cry1Aa15 (Accession #AAY66993); Cry1Aa16 (Accession #HQ439776); Cry1Aa 17 (Accession #HQ439788); Cry1Aa18 (Accession #HQ439790); Cry1Aa19 (Accession #HQ685121); Cry1Aa20 (Accession #JF340156); Cry1Aa21 (Accession #JN651496); Cry1Aa22 (Accession #KC 158223); Cry1Ab1 (Accession #AAA22330); Cry1Ab2 (Accession #AAA22613); Cry1Ab3 (Accession #AAA22561); Cry1Ab4 (Accession #BAA00071); Cry1Ab5 (Accession #CAA28405); Cry1Ab6 (Accession #AAA22420); Cry1Ab7 (Accession #CAA31620); Cry1Ab8 (Accession #AAA22551); Cry1Ab9 (Accession #CAA38701); Cry 1Ab10 (Accession #A29125); Cry1Ab11 (Accession #I12419); Cry1Ab12 (Accession #AAC64003); Cry1Ab13 (Accession #AAN76494); Cry1Ab 14 (Accession #AAG16877); Cry1Ab15 (Accession #AA013302); Cry1Ab16 (Accession #AAK55546); Cry1Ab17 (Accession #AAT46415); Cry1Ab18 (Accession #AAQ88259); Cry1Ab19 (Accession #AAW31761); Cry1Ab20 (Accession #ABB72460); Cry1Ab21 (Accession #ABS18384); Cry1Ab22 (Accession #ABW87320); Cry1Ab23 (Accession #HQ439777); Cry1Ab24 (Accession #HQ439778); Cry1Ab25 (Accession #HQ685122); Cry1Ab26 (Accession #HQ847729); Cry1Ab27 (Accession

#JN135249); Cry1Ab28 (Accession #JN135250); Cry1Ab29 (Accession #JN135251); Cry1Ab30 (Accession #JN135252); Cry1Ab31 (Accession #JN135253); Cry1Ab32 (Accession #JN 135254); Cry1Ab33 (Accession #AAS93798); Cry1Ab34 (Accession #KC156668); Cry1Ab-like (Accession #AAK14336); Cry1Ab-like (Accession #AAK14337); Cry1Ab-like (Accession #AAK14338); Cry1Ab-like (Accession #ABG88858); Cry1Ac1 (Accession #AAA22331); Cry1Ac2 (Accession #AAA22338); Cry1Ac3 (Accession #CAA38098); Cry1Ac4 (Accession #AAA73077); Cry1Ac5 (Accession #AAA22339); Cry1Ac6 (Accession #AAA86266); Cry1Ac7 (Accession #AAB46989); Cry1Ac8 (Accession #AAC44841); Cry1Ac9 (Accession #AAB49768); Cry1Ac10 (Accession #CAA05505); Cry1Ac 11 (Accession #CAA 10270); Cry1Ac 12 (Accession #I12418); Cry1Ac13 (Accession #AAD38701); Cry1Ac14 (Accession #AAQ06607); Cry1Ac15 (Accession #AAN07788); Cry1Ac16 (Accession #AAU87037); Cry1Ac17 (Accession #AAX18704); Cry1Ac18 (Accession #AAY88347); Cry1Ac19 (Accession #ABD37053); Cry1Ac20 (Accession #ABB89046); Cry1Ac21 (Accession #AAY66992); Cry1Ac22 (Accession #ABZ01836); Cry1Ac23 (Accession #CAQ30431); Cry1Ac24 (Accession #ABL01535); Cry1Ac25 (Accession #FJ513324); Cry1Ac26 (Accession #FJ617446); Cry1Ac27 (Accession #FJ617447); Cry1Ac28 (Accession #ACM90319); Cry1Ac29 (Accession #DQ438941); Cry1Ac30 (Accession #GQ227507); Cry1Ac31 (Accession #GU446674); Cry1Ac32 (Accession #HM061081); Cry1Ac33 (Accession #GQ866913); Cry1Ac34 (Accession #HQ230364); Cry1Ac35 (Accession #JF340157); Cry1Ac36 (Accession #JN387137); Cry1Ac37 (Accession #JQ317685); Cry1Ad1 (Accession #AAA22340); Cry1Ad2 (Accession #CAA01880); Cry1Ae1 (Accession #AAA22410); Cry1Af1 (Accession #AAB82749); Cry1Ag1 (Accession #AAD46137); Cry1Ah1 (Accession #AAQ14326); Cry1Ah2 (Accession #ABB76664); Cry1Ah3 (Accession #HQ439779); Cry1Ai1 (Accession #AA039719); Cry1Ai2 (Accession #HQ439780); Cry1A-like (Accession #AAK14339); Cry1Ba1 (Accession #CAA29898); Cry1Ba2 (Accession #CAA65003); Cry1Ba3 (Accession #AAK63251); Cry1Ba4 (Accession #AAK51084); Cry1Ba5 (Accession #AB020894); Cry1Ba6 (Accession #ABL60921); Cry1Ba7 (Accession #HQ439781); Cry1Bb1 (Accession #AAA22344); Cry1Bb2 (Accession #HQ439782); Cry1Bc1 (Accession #CAA86568); Cry1Bd1 (Accession #AAD10292); Cry1Bd2 (Accession #AAM93496); Cry1Be1 (Accession #AAC32850); Cry1Be2 (Accession #AAQ52387); Cry1Be3 (Accession #ACV96720); Cry1Be4 (Accession #HM070026); Cry1Bf1 (Accession #CAC50778); Cry1Bf2 (Accession #AAQ52380); Cry1Bg1 (Accession #AA039720); Cry1Bh1 (Accession #HQ589331); Cry1Bi1 (Accession #KC 156700); Cry1Ca1 (Accession #CAA30396); Cry1Ca2 (Accession #CAA31951); Cry1Ca3 (Accession #AAA22343); Cry1Ca4 (Accession #CAA01886); Cry1Ca5 (Accession #CAA65457); Cry1Ca6 [1] (Accession #AAF37224); Cry1Ca7 (Accession #AAG50438); Cry1Ca8 (Accession #AAM00264); Cry1Ca9 (Accession #AAL79362); Cry1Ca10 (Accession #AAN16462); Cry1Ca11 (Accession #AAX53094); Cry 1 Ca 12 (Accession #HM070027); Cry1Ca 13 (Accession #HQ412621); Cry Ca 14 (Accession #JN651493); Cry1Cb1 (Accession #M97880); Cry1Cb2 (Accession #AAG35409); Cry1Cb3 (Accession #ACD50894); Cry1Cb-like (Accession #AAX63901); Cry1Da1 (Accession #CAA38099); Cry1Da2 (Accession #I76415); Cry1Da3 (Accession #HQ439784); Cry1Db1 (Accession #CAA80234); Cry1Db2 (Accession #AAK48937); Cry1Dc1 (Accession #ABK35074); Cry1Ea1 (Accession #CAA37933); Cry1Ea2 (Accession #CAA39609); Cry1Ea3 (Accession #AAA22345); Cry 1 Ea4 (Accession #AAD04732); Cry1Ea5 (Accession #A15535); Cry1Ea6 (Accession #AAL50330); Cry1Ea7 (Accession #AAW72936); Cry1Ea8 (Accession #ABX11258); Cry1Ea9 (Accession #HQ439785); Cry1Ea10 (Accession #ADR00398); Cry1Ea11 (Accession #JQ652456); Cry1Eb1 (Accession #AAA22346); Cry1Fa1 (Accession #AAA22348); Cry1Fa2 (Accession #AAA22347); Cry1Fa3 (Accession #HM070028); Cry 1 Fa4 (Accession #HM439638); Cry1Fb1 (Accession #CAA80235); Cry1Fb2 (Accession #BAA25298); Cry1Fb3 (Accession #AAF21767); Cry1Fb4 (Accession #AAC10641); Cry1Fb5 (Accession #AA013295); Cry1Fb6 (Accession #ACD50892); Cry1Fb7 (Accession #ACD50893); Cry1Ga1 (Accession #CAA80233); Cry1Ga2 (Accession #CAA70506); Cry1Gb1 (Accession #AAD 10291); Cry1Gb2 (Accession #AA013756); Cry1Gc1(Accession #AAQ52381); Cry1Ha1 (Accession #CAA80236); Cry1Hb1(Accession #AAA79694); Cry1Hb2 (Accession #HQ439786); Cry1H-like (Accession #AAF01213); Cry1Ia1 (Accession #CAA44633); Cry1Ia2 (Accession #AAA22354); Cry1Ia3 (Accession #AAC36999); Cry1Ia4 (Accession #AAB00958); Cry1Ia5 (Accession #CAA70124); Cry1Ia6 (Accession #AAC26910); Cry1Ia7 (Accession #AAM73516); Cry1Ia8 (Accession #AAK66742); Cry1Ia9 (Accession #AAQ08616); Cry1Ia10 (Accession #AAP86782); Cry1Ia11 (Accession #CAC85964); Cry1Ia12 (Accession #AAV53390); Cry1Ia13 (Accession #ABF83202); Cry1Ia14 (Accession #ACG63871); Cry1Ia15 (Accession #FJ617445); Cry1Ia16 (Accession #FJ617448); Cry1Ia17 (Accession #GU989199); Cry1Ia18 (Accession #ADK23801); Cry1Ia19 (Accession #HQ439787); Cry1Ia20 (Accession #JQ228426); Cry1Ia21 (Accession #JQ228424); Cry1Ia22 (Accession #JQ228427); Cry1Ia23 (Accession #JQ228428); Cry1Ia24 (Accession #JQ228429); Cry1Ia25 (Accession #JQ228430); Cry1Ia26 (Accession #JQ228431); Cry1Ia27 (Accession #JQ228432); Cry1Ia28 (Accession #JQ228433); Cry1Ia29 (Accession #JQ228434); Cry1Ia30 (Accession #JQ317686); Cry1Ia31 (Accession #JX944038); Cry1Ia32 (Accession #JX944039); Cry 1Ia33 (Accession #JX944040); Cry1Ib1 (Accession #AAA82114); Cry1Ib2 (Accession #ABW88019); Cry1Ib3 (Accession #ACD75515); Cry1Ib4 (Accession #HM051227); Cry1Ib5 (Accession #HM070028); Cry1Ib6 (Accession #ADK38579); Cry1Ib7 (Accession #JN571740); Cry1Ib8 (Accession #JN675714); Cry1Ib9 (Accession #JN675715); Cry1Ib10 (Accession #JN675716); Cry1Ib11 (Accession #JQ228423); Cry1Ic1 (Accession #AAC62933); Cry1Ic2 (Accession #AAE71691); Cry1Id1 (Accession #AAD44366); Cry1Id2 (Accession #JQ228422); Cry1Ie1 (Accession #AAG43526); Cry1Ie2 (Accession #HM439636); Cry1Ie3 (Accession #KC156647); Cry1Ie4 (Accession #KC156681); Cry1If1 (Accession #AAQ52382); Cry1Ig1 (Accession #KC 156701); Cry1I-like (Accession #AAC31094); Cry1I-like (Accession #ABG88859); Cry1Ja1 (Accession #AAA22341); Cry 1 Jag (Accession #HM070030); Cry1Ja3 (Accession #JQ228425); Cry1Jb1 (Accession #AAA98959); Cry1Jc1 (Accession #AAC31092); Cry1Jc2 (Accession #AAQ52372); Cry1Jd1 (Accession #CAC50779); CrylKal (Accession #AAB00376); Cry1Ka2 (Accession #HQ439783); Cry1La1 (Accession #AAS60191); Cry1La2 (Accession

#HM070031); Cry1Ma1 (Accession #FJ884067); Cry1Ma2 (Accession #KC156659); Cry1Na1 (Accession #KC156648); Cry1Nb1 (Accession #KC156678); Cry1-like (Accession #AAC31091); Cry2Aa1 (Accession #AAA22335); Cry2Aa2 (Accession #AAA83516); Cry2Aa3 (Accession #D86064); Cry2Aa4 (Accession #AAC04867); Cry2Aa5 (Accession #CAA10671); Cry2Aa6 (Accession #CAA10672); Cry2Aa7 (Accession #CAA10670); Cry2Aa8 (Accession #AA013734); Cry2Aa9 (Accession #AA013750); Cry2Aa10 (Accession #AAQ04263); Cry2Aa11 (Accession #AAQ52384); Cry2Aa12 (Accession #AB183671); Cry2Aa13 (Accession #ABL01536); Cry2Aa14 (Accession #ACF04939); Cry2Aa15 (Accession #JN426947); Cry2Ab1 (Accession #AAA22342); Cry2Ab2 (Accession #CAA39075); Cry2Ab3 (Accession #AAG36762); Cry2Ab4 (Accession #AA013296); Cry2Ab5 (Accession #AAQ04609); Cry2Ab6 (Accession #AAP59457); Cry2Ab7 (Accession #AAZ66347); Cry2Ab8 (Accession #ABC95996); Cry2Ab9 (Accession #ABC74968); Cry2Ab10 (Accession #EF157306); Cry2Ab11 (Accession #CAM84575); Cry2Ab12 (Accession #ABM21764); Cry2Ab13 (Accession #ACG76120); Cry2Ab14 (Accession #ACG76121); Cry2Ab15 (Accession #HM037126); Cry2Ab16 (Accession #GQ866914); Cry2Ab17 (Accession #HQ439789); Cry2Ab18 (Accession #JN135255); Cry2Ab19 (Accession #JN135256); Cry2Ab20 (Accession #JN135257); Cry2Ab21 (Accession #JN135258); Cry2Ab22 (Accession #JN135259); Cry2Ab23 (Accession #JN135260); Cry2Ab24 (Accession #JN135261); Cry2Ab25 (Accession #JN415485); Cry2Ab26 (Accession #JN426946); Cry2Ab27 (Accession #JN415764); Cry2Ab28 (Accession #JN651494); Cry2Ac1 (Accession #CAA40536); Cry2Ac2 (Accession #AAG35410); Cry2Ac3 (Accession #AAQ52385); Cry2Ac4 (Accession #ABC95997); Cry2Ac5 (Accession #ABC74969); Cry2Ac6 (Accession #ABC74793); Cry2Ac7 (Accession #CAL18690); Cry2Ac8 (Accession #CAM09325); Cry2Ac9 (Accession #CAM09326); Cry2Ac10 (Accession #ABN15104); Cry2Ac11 (Accession #CAM83895); Cry2Ac12 (Accession #CAM83896); Cry2Ad1 (Accession #AAF09583); Cry2Ad2 (Accession #ABC86927); Cry2Ad3 (Accession #CAK29504); Cry2Ad4 (Accession #CAM32331); Cry2Ad5 (Accession #CA078739); Cry2Ae1 (Accession #AAQ52362); Cry2Af1 (Accession #AB030519); Cry2Af2. (Accession #GQ866915); Cry2Ag1 (Accession #ACH91610); Cry2Ah1 (Accession #EU939453); Cry2Ah2 (Accession #ACL80665); Cry2Ah3 (Accession #GU073380); Cry2Ah4 (Accession #KC156702); Cry2Ai1 (Accession #FJ788388); Cry2Aj (Accession #); Cry2Ak1 (Accession #KC156660); Cry2Ba1 (Accession #KC156658); Cry3Aa1 (Accession #AAA22336); Cry3Aa2 (Accession #AAA22541); Cry3Aa3 (Accession #CAA68482); Cry3Aa4 (Accession #AAA22542); Cry3Aa5 (Accession #AAA50255); Cry3Aa6 (Accession #AAC43266); Cry3Aa7 (Accession #CAB41411); Cry3Aa8 (Accession #AAS79487); Cry3Aa9 (Accession #AAW05659); Cry3Aa10 (Accession #AAU29411); Cry3Aa11 (Accession #AAW82872); Cry3Aa12 (Accession #ABY49136); Cry3Ba1 (Accession #CAA34983); Cry3Ba2 (Accession #CAA00645); Cry3Ba3 (Accession #JQ397327); Cry3Bb1 (Accession #AAA22334); Cry3Bb2 (Accession #AAA74198); Cry3Bb3 (Accession #I15475); Cry3Ca1 (Accession #CAA42469); Cry4Aa1 (Accession #CAA68485); Cry4Aa2 (Accession #BAAO01 79); Cry4Aa3 (Accession #CAD30148); Cry4Aa4 (Accession #AFB18317); Cry4A-like (Accession #AAY96321); Cry4Ba1 (Accession #CAA30312); Cry4Ba2 (Accession #CAA30114); Cry4Ba3 (Accession #AAA22337); Cry4Ba4 (Accession #BAAO01 78); Cry4Ba5 (Accession #CAD30095); Cry4Ba-like (Accession #ABC47686); Cry4Ca1 (Accession #EU646202); Cry4Cb1 (Accession #FJ403208); Cry4Cb2 (Accession #FJ597622); Cry4Cc1 (Accession #FJ403207); Cry5Aa1 (Accession #AAA67694); Cry5Ab1 (Accession #AAA67693); Cry5Ac1 (Accession #I34543); Cry5Ad1 (Accession #ABQ82087); Cry5Ba1 (Accession #AAA68598); Cry5Ba2 (Accession #ABW88931); Cry5Ba3 (Accession #AFJ04417); Cry5Ca1 (Accession #HM461869); Cry5Ca2 (Accession #ZP_04123426); Cry5Da1 (Accession #HM461870); Cry5Da2 (Accession #ZP 04123980); Cry5Ea1 (Accession #HM485580); Cry5Ea2 (Accession #ZP_04124038); Cry6Aa1 (Accession #AAA22357); Cry6Aa2 (Accession #AAM46849); Cry6Aa3 (Accession #ABH03377); Cry6Ba1 (Accession #AAA22358); Cry7 Aa1 (Accession #AAA22351); Cry7Ab1 (Accession #AAA21120); Cry7Ab2 (Accession #AAA21121); Cry7Ab3 (Accession #ABX24522); Cry7 Ab4 (Accession #EU380678); Cry7 Ab5 (Accession #ABX79555); Cry7 Ab6 (Accession #ACI44005); Cry7 Ab7 (Accession #ADB89216); Cry7 Ab8 (Accession #GU145299); Cry7Ab9 (Accession #ADD92572); Cry7Ba1 (Accession #ABB70817); Cry7Bb1 (Accession #KCl 56653); Cry7Ca1 (Accession #ABR67863); Cry7Cb1 (Accession #KC156698); Cry7Da1 (Accession #ACQ99547); Cry7Da2 (Accession #HM572236); Cry7Da3 (Accession #KC156679); Cry7Ea1 (Accession #HM035086); Cry7Ea2 (Accession #HM132124); Cry7Ea3 (Accession #EEM19403); Cry7Fa1 (Accession #HM035088); Cry7Fa2 (Accession #EEMI 9090); Cry7Fb1 (Accession #HM572235); Cry7Fb2 (Accession #KCl 56682); Cry7Ga1 (Accession #HM572237); Cry7Ga2 (Accession #KC 156669); Cry7Gb1 (Accession #KC156650); Cry7Gc1 (Accession #KC156654); Cry7Gd1 (Accession #KC156697); Cry7Ha1 (Accession #KC 156651); Cry7Ia1 (Accession #KC 156665); Cry7Ja1 (Accession #KC 156671); Cry7Ka1 (Accession #KC156680); Cry7Kb1 (Accession #BAM99306); Cry7La1 (Accession #BAM99307); Cry8Aa1 (Accession #AAA21117); Cry8Ab1 (Accession #EU044830); Cry8Ac1 (Accession #KC156662); Cry8Ad1 (Accession #KC156684); Cry8Ba1 (Accession #AAA21118); Cry8Bb1 (Accession #CAD57542); Cry8Bc1 (Accession #CAD57543); Cry8Ca1 (Accession #AAA21119); Cry8Ca2 (Accession #AAR98783); Cry8Ca3 (Accession #EU625349); Cry8Ca4 (Accession #ADB54826); Cry8Da1 (Accession #BAC07226); Cry8Da2 (Accession #BD133574); Cry8Da3 (Accession #BD133575); Cry8Db1 (Accession #BAF93483); Cry8Ea1 (Accession #AAQ73470); Cry8Ea2 (Accession #EU047597); Cry8Ea3 (Accession #KC855216); Cry8Fa1 (Accession #AAT48690); Cry8Fa2 (Accession #HQI 74208); Cry8Fa3 (Accession #AFH78109); Cry8Ga1 (Accession #AAT46073); Cry8Ga2 (Accession #ABC42043); Cry8Ga3 (Accession #FJ198072); Cry8Ha1 (Accession #AAW81032); Cry8Ia1 (Accession #EU381044); Cry8Ia2 (Accession #GU073381); Cry8Ia3 (Accession #HM044664); Cry8Ia4 (Accession #KCI56674); Cry8Ib1 (Accession #GU325772); Cry8Ib2 (Accession #KC156677); Cry8Ja1 (Accession #EU625348); Cry8Ka1 (Accession #FJ422558); Cry8Ka2 (Accession #ACN87262); Cry8Kb1 (Accession #HM123758); Cry8Kb2 (Accession #KC156675); Cry8La1 (Accession #GU325771); Cry8Ma1 (Accession #HM044665); Cry8Ma2 (Accession #EEM86551); Cry8Ma3 (Accession

#HM210574); Cry8Na1 (Accession #HM640939); Cry8Pa1 (Accession #HQ388415); Cry8Qa1 (Accession #HQ441166); Cry8Qa2 (Accession #KC152468); Cry8Ra1 (Accession #AFP87548); Cry8Sa1 (Accession #JQ740599); Cry8Ta1 (Accession #KC156673); Cry8-like (Accession #FJ770571); Cry8-like (Accession #ABS53003); Cry9Aa1 (Accession #CAA41122); Cry9Aa2 (Accession #CAA41425); Cry9Aa3 (Accession #GQ249293); Cry9Aa4 (Accession #GQ249294); Cry9Aa5 (Accession #JX174110); Cry9Aa like (Accession #AAQ52376); Cry9Ba1 (Accession #CAA52927); Cry9Ba2 (Accession #GU299522); Cry9Bb1 (Accession #AAV28716); Cry9Ca1 (Accession #CAA85764); Cry9Ca2 (Accession #AAQ52375); Cry9Da1 (Accession #BAAI 9948); Cry9Da2 (Accession #AAB97923); Cry9Da3 (Accession #GQ249293); Cry9Da4 (Accession #GQ249297); Cry9Db1 (Accession #AAX78439); Cry9Dc1 (Accession #KC156683); Cry9Ea1 (Accession #BAA34908); Cry9Ea2 (Accession #AA012908); Cry9Ea3 (Accession #ABM21765); Cry9Ea4 (Accession #ACE88267); Cry9Ea5 (Accession #ACF04743); Cry9Ea6 (Accession #ACG63872); Cry9Ea7 (Accession #FJ380927); Cry9Ea8 (Accession #GQ249292); Cry9Ea9 (Accession #JN651495); Cry9Eb1 (Accession #CAC50780); Cry9Eb2 (Accession #GQ249298); Cry9Eb3 (Accession #KC156646); Cry9Ec1 (Accession #AAC63366); Cry9Ed1 (Accession #AAX78440); Cry9Ee1 (Accession #GQ249296); Cry9Ee2 (Accession #KC156664); Cry9Fa1 (Accession #KC156692); Cry9Ga1 (Accession #KC156699); Cry9-like (Accession #AAC63366); Cry10Aa1 (Accession #AAA22614); Cry 10Aa2 (Accession #E00614); Cry 10Aa3 (Accession #CAD30098); Cry10Aa4 (Accession #AFB18318); Cry10A-like (Accession #DQ167578); Cry11Aa1 (Accession #AAA22352); Cry11Aa2 (Accession #AAA22611); Cry11Aa3 (Accession #CAD30081); Cry11Aa4 (Accession #AFB18319); Cry11Aa-like (Accession #DQ166531); Cry11Ba1 (Accession #CAA60504); Cry11Bb1 (Accession #AAC97162); Cry11Bb2 (Accession #HM068615); Cry12Aa1 (Accession #AAA22355); Cry13Aa1 (Accession #AAA22356); Cry14Aa1 (Accession #AAA21516); Cry14Ab1 (Accession #KC156652); Cry15Aa1 (Accession #AAA22333); Cry16Aa1 (Accession #CAA63860); Cry17Aa1 (Accession #CAA67841); Cry18Aa1 (Accession #CAA67506); Cry18Ba1 (Accession #AAF89667); Cry18Ca1 (Accession #AAF89668); Cry19Aa1 (Accession #CAA68875); Cry19Ba1 (Accession #BAA32397); Cry19Ca1 (Accession #AFM37572); Cry20Aa1 (Accession #AAB93476); Cry20Ba1 (Accession #ACS93601); Cry20Ba2 (Accession #KC156694); Cry20-like (Accession #GQ144333); Cry21Aa1 (Accession #I32932); Cry21Aa2 (Accession #I66477); Cry21Ba1 (Accession #BAC06484); Cry21Ca1 (Accession #JF521577); Cry21Ca2 (Accession #KC 156687); Cry21Da1 (Accession #JF521578); Cry22Aa1 (Accession #I34547); Cry22Aa2 (Accession #CAD43579); Cry22Aa3 (Accession #ACD93211); Cry22Ab1 (Accession #AAK50456); Cry22Ab2 (Accession #CAD43577); Cry22Ba1 (Accession #CAD43578); Cry22Bb1 (Accession #KC156672); Cry23Aa1 (Accession #AAF76375); Cry24Aa1 (Accession #AAC61891); Cry24Ba1 (Accession #BAD32657); Cry24Ca1 (Accession #CAJ43600); Cry25Aa1 (Accession #AAC61892); Cry26Aa1(Accession #AAD25075); Cry27Aa1 (Accession #BAA82796); Cry28Aa1 (Accession #AAD24189); Cry28Aa2 (Accession #AAG00235); Cry29Aa1(Accession #CAC80985); Cry30Aa1 (Accession #CAC80986); Cry30Ba1 (Accession #BAD00052); Cry30Ca1 (Accession #BAD67157); Cry30Ca2 (Accession #ACU24781); Cry30Da1 (Accession #EF095955); Cry30Db1 (Accession #BAE80088); Cry30Ea1 (Accession #ACC95445); Cry30Ea2 (Accession #FJ499389); Cry30Fa1 (Accession #AC122625); Cry30Ga1 (Accession #ACG60020); Cry30Ga2 (Accession #HQ638217); Cry31Aa1 (Accession #BABll 757); Cry31Aa2 (Accession #AAL87458); Cry31Aa3 (Accession #BAE79808); Cry31Aa4 (Accession #BAF32571); Cry31Aa5 (Accession #BAF32572); Cry31Aa6 (Accession #BA144026); Cry31Ab1 (Accession #BAE79809); Cry31Ab2 (Accession #BAF32570); Cry31Ac1 (Accession #BAF34368); Cry31Ac2 (Accession #AB731600); Cry31Ad1 (Accession #BA144022); Cry32Aa1 (Accession #AAG36711); Cry32Aa2 (Accession #GU063849); Cry32Ab1(Accession #GU063850); Cry32Ba1 (Accession #BAB78601); Cry32Ca1(Accession #BAB78602); Cry32Cb1(Accession #KC156708); Cry32Da1 (Accession #BAB78603); Cry32Ea1 (Accession #GU324274); Cry32Ea2 (Accession #KC156686); Cry32Eb1 (Accession #KC156663); Cry32Fa1(Accession #KC156656); Cry32Ga1 (Accession #KC156657); Cry32Ha1 (Accession #KC156661); Cry32Hb1 (Accession #KC156666); Cry32Ia1 (Accession #KCl 56667); Cry32Ja1 (Accession #KCl 56685); Cry32Ka1 (Accession #KCl 56688); Cry32La1 (Accession #KC156689); Cry32Ma1 (Accession #KC156690); Cry32Mb1(Accession #KCI56704); Cry32Na1(Accession #KC 156691); Cry32Oa1 (Accession #KC156703); Cry32Pa1 (Accession #KC156705); Cry32Qa1 (Accession #KC156706); Cry32Ra1(Accession #KC156707); Cry32Sa1(Accession #KC156709); Cry32Ta1 (Accession #KC156710); Cry32Ua1 (Accession #KC156655); Cry33Aa1 (Accession #AAL26871); Cry34Aa1 (Accession #AAG50341); Cry34Aa2 (Accession #AAK64560); Cry34Aa3 (Accession #AAT29032); Cry34Aa4 (Accession #AAT29030); Cry34Ab1(Accession #AAG41671); Cry34Ac1 (Accession #AAG50118); Cry34Ac2 (Accession #AAK64562); Cry34Ac3 (Accession #AAT29029); Cry34Ba1 (Accession #AAK64565); Cry34Ba2 (Accession #AAT29033); Cry34Ba3 (Accession #AAT29031); Cry35Aa1 (Accession #AAG50342); Cry35Aa2 (Accession #AAK64561); Cry35Aa3 (Accession #AAT29028); Cry35Aa4 (Accession #AAT29025); Cry35Ab1 (Accession #AAG41672); Cry35Ab2 (Accession #AAK64563); Cry35Ab3 (Accession #AY536891); Cry35Ac1 (Accession #AAG50117); Cry35Ba1 (Accession #AAK64566); Cry35Ba2 (Accession #AAT29027); Cry35Ba3 (Accession #AAT29026); Cry36Aa1 (Accession #AAK64558); Cry37Aa1 (Accession #AAF76376); Cry38Aa1(Accession #AAK64559); Cry39Aa1 (Accession #BAB72016); Cry40Aa1 (Accession #BAB72018); Cry40Ba1 (Accession #BAC77648); Cry40Ca1(Accession #EU381045); Cry40Da1(Accession #ACF15199); Cry41Aa1 (Accession #BAD35157), Cry41Ab1 (Accession #BAD35163); Cry41 Ba1 (Accession #HM461871); Cry41Ba2 (Accession #ZP_04099652); Cry42Aa1 (Accession #BAD35166); Cry43Aa1 (Accession #BAD15301); Cry43Aa2 (Accession #BAD95474); Cry43Ba1 (Accession #BAD15303); Cry43Ca1 (Accession #KC156676); Cry43Cb1 (Accession #KC156695); Cry43Cc1 (Accession #KC156696); Cry43-like (Accession #BAD15305); Cry44Aa (Accession #BAD08532); Cry45Aa (Accession #BAD22577); Cry46Aa (Accession #BAC79010); Cry46Aa2 (Accession #BAG68906); Cry46Ab (Accession #BAD35170); Cry47 Aa (Accession #AAY24695); Cry48Aa (Accession #CAJ18351); Cry48Aa2 (Accession #CAJ86545); Cry48Aa3 (Accession #CAJ86546); Cry48Ab (Accession #CAJ86548); Cry48Ab2 (Accession

#CAJ86549); Cry49Aa (Accession #CAH56541); Cry49Aa2 (Accession #CAJ86541); Cry49Aa3 (Accession #CAJ86543); Cry49Aa4 (Accession #CAJ86544); Cry49Ab1 (Accession #CAJ86542); Cry50Aa1 (Accession #BAE86999); Cry50Ba1 (Accession #GU446675); Cry50Ba2 (Accession #GU446676); Cry51Aa1 (Accession #AB114444); Cry51Aa2 (Accession #GU570697); Cry52Aa1 (Accession #EF613489); Cry52Ba1 (Accession #FJ361760); Cry53Aa1 (Accession #EF633476); Cry53Ab1 (Accession #FJ361759); Cry54Aa1 (Accession #ACA52194); Cry54Aa2 (Accession #GQ140349); Cry54Ba1 (Accession #GU446677); Cry55Aa1 (Accession #ABW88932); Cry54Ab1 (Accession #JQ916908); Cry55Aa2 (Accession #AAE33526); Cry56Aa1 (Accession #ACU57499); Cry56Aa2 (Accession #GQ483512); Cry56Aa3 (Accession #JX025567); Cry57Aa1 (Accession #ANC87261); Cry58Aa1 (Accession #ANC87260); Cry59Ba1 (Accession #JN790647); Cry59Aa1 (Accession #ACR43758); Cry60Aa1 (Accession #ACU24782); Cry60Aa2 (Accession #EA057254); Cry60Aa3 (Accession #EEM99278); Cry60Ba1 (Accession #GU810818); Cry60Ba2 (Accession #EA057253); Cry60Ba3 (Accession #EEM99279); Cry61Aa1 (Accession #HM035087); Cry61 Aa2 (Accession #HM132125); Cry61Aa3 (Accession #EEM19308); Cry62Aa1 (Accession #HM054509); Cry63Aa1 (Accession #BA144028); Cry64Aa1(Accession #BAJ05397); Cry65Aa1 (Accession #HM461868); Cry65Aa2 (Accession #ZP 04123838); Cry66Aa1 (Accession #HM485581); Cry66Aa2 (Accession #ZP_04099945); Cry67Aa1 (Acces-sion #HM485582); Cry67Aa2 (Accession #ZP 04148882); Cry68Aa1 (Accession #HQ113114); Cry69Aa1 (Accession #HQ401006); Cry69Aa2 (Accession #JQ821388); Cry69Ab1 (Accession #JN209957); Cry70Aa1 (Accession #JN646781); Cry70Ba1 (Accession #AD051070); Cry70Bb1 (Accession #EEL67276); Cry71Aa1 (Accession #JX025568); Cry72Aa1 (Accession #JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to CryA proteins of U.S. Pat. Nos. 5,880,275, 7,858,849 8,530,411, 8,575,433, and 8,686,233; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families, including but not limited to the Cry9D protein of U.S. Pat. No. 8,802,933 and the Cry9B protein of U.S. Pat. No. 8,802,934; a Cry 15 protein of Naimov, et al., (2008), "Applied and Environmental Microbiology," 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949, 626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC 127, TIC128 of PCT US 2006/033867; TIC853 toxins of U.S. Pat. No. 8,513,494, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMII-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247 and U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXIVII 114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, AXMI270 of US Patent Application Publication US20140223598, AXMI279 of US Patent Application Publication US20140223599, cry proteins such as Cry1A and Cry3A having modified proteolytic sites of U.S. Pat. No. 8,319,019; a Cry1Ac, Cry2Aa and Cry 1 Ca toxin protein from *Bacillus thuringiensis* strain VBTS 2528 of US Patent Application Publication Number 2011/0064710. Other Cry proteins are well known to one skilled in the art. See, N. Crickmore, et al., "Revision of the Nomenclature for the *Bacillus thuringiensis* Pesticidal Crystal Proteins,"

Microbiology and Molecular Biology Reviews," (1998) Vol 62: 807-813; see also, N. Crickmore, et al., "*Bacillus thuringiensis* toxin nomenclature" (2016), at www.btnomenclature.info/.

The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval. See, Sanahuja et al., "*Bacillus thuringiensis*: a century of research, development and commercial applications," (2011) Plant Biotech Journal, April 9(3):283-300 and the CERA (2010) GM Crop Database Center for Environmental Risk Assessment (CERA), ILSI Research Foundation, Washington D.C. at cera-gmc.org/index.php?action=gm_crop_database, which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US201210311746); Cry1CA & Cry1AB (US2012/0311745); Cry1F & CryCa (US2012/0317681); Cry1DA& Cry1BE (US2012/0331590); Cry1DA & Cry1Fa (US2012/0331589); Cry1AB & Cry1BE (US2012/0324606); Cry1Fa & Cry2Aa and Cry11 & Cry1E (US2012'0324605); Cry34Ab/35Ab and Cry6Aa (US20130167269); Cry34Ab/VCry35Ab & Cry3Aa (US20130167268); Cry1Ab & Cry1F (US20140182018); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) Biochem Biophys Res Commun 15:1406-1413).

Pesticidal proteins also include VIP (vegetative insecticidal proteins) toxins. Entomopathogenic bacteria produce insecticidal proteins that accumulate in inclusion bodies or parasporal crystals (such as the aforementioned Cry and Cyt proteins), as well as insecticidal proteins that are secreted into the culture medium. Among the latter are the Vip proteins, which are divided into four families according to their amino acid identity. The Vip1 and Vip2 proteins act as binary toxins and are toxic to some members of the Coleoptera and Hemiptera. The Vip1 component is thought to bind to receptors in the membrane of the insect midgut, and the Vip2 component enters the cell, where it displays its ADP-ribosyltransferase activity against actin, preventing microfilament formation. Vip3 has no sequence similarity to Vip1 or Vip2 and is toxic to a wide variety of members of the Lepidoptera. Its mode of action has been shown to resemble that of the Cry proteins in terms of proteolytic activation, binding to the midgut epithelial membrane, and pore formation, although Vip3A proteins do not share binding sites with Cry proteins. The latter property makes them good candidates to be combined with Cry proteins in transgenic plants (*Bacillus thuringiensis*-treated crops [Bt crops]) to prevent or delay insect resistance and to broaden the insecticidal spectrum. There are commercially grown varieties of Bt cotton and Bt maize that express the Vip3Aa protein in combination with Cry proteins. For the most recently reported Vip4 family, no target insects have been found yet. See, Chakroun et al., "Bacterial Vegetative Insecticidal Proteins (Vip) from Entomopathogenic Bacteria," Microbiol Mol Biol Rev. 2016 Mar. 2; 80(2):329-50. VIPs can be found in U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html, which can be accessed on the world-wide web using the "www" prefix).

Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1 Wi. Examples of Class C proteins are TccC, XptClXb and XptBl Wi. Pesticidal proteins also include spider, snake and scorpion venom proteins. Examples of spider venom peptides include, but are not limited to lycotoxin-1 peptides and mutants thereof (U.S. Pat. No. 8,334,366).

Some currently registered PIPs are listed in Table 11. Transgenic plants have also been engineered to express dsRNA directed against insect genes (Baum, J. A. et al. (2007) Control of coleopteran insect pests through RNA interference. Nature Biotechnology 25: 1322-1326; Mao, Y. B. et al. (2007) Silencing a cotton bollworm P450 monooxygenase gene by plant-mediated RNAi impairs larval tolerance of gossypol. Nature Biotechnology 25: 1307-1313). RNA interference can be triggered in the pest by feeding of the pest on the transgenic plant. Pest feeding thus causes injury or death to the pest.

TABLE 11

List of exemplary Plant-incorporated Protectants, which can be combined with microbes of the disclosure

| Plant-Incorporated Protectants (PIPs) | Company and Trade Names | Pesticide Registration Numbers |
|---|---|---|
| Potato | Potato | |
| Cry3A Potato PC Code 006432 | Naturemark | 524-474 |
| | New Leaf Monsanto | |
| Cry3A & PLRV Potato | Monsanto | 524-498 |
| PC Codes 006432, 006469 | New Leaf Plus | |
| Corn | | |
| Cry1Ab Corn Event 176 PC Code 006458 | Mycogen Seeds/Dow | 68467-1 |
| | Agro | 66736-1 |
| | Syngenta Seeds | |

TABLE 11-continued

List of exemplary Plant-incorporated Protectants, which can be combined with microbes of the disclosure

| Plant-Incorporated Protectants (PIPs) | Company and Trade Names | Pesticide Registration Numbers |
|---|---|---|
| Cry1Ab Corn Event Bt11 EPA PC Code 006444 OECD Unique Identifier SYN-BTØ11-1, | Agrisure CB (with Yieldgard) Attribute Insect Protected Sweet Corn Syngenta Seeds | 67979-1 65268-1 |
| Cry1Ab Corn Event MON 801 | Monsanto | 524-492 |
| Cry1Ab corn Event MON 810 PC Code 006430 OECD Unique Identifier MON-ØØ81Ø-6 | Monsanto | 524-489 |
| Cry1Ac Corn PC Code 006463 | Dekalb Genetics c/o Monsanto BT-XTRA | 69575-2 |
| Cry1F corn Event TC1507 PC Code 006481 OECD Unique Identifier DAS-Ø15Ø7-1 | Mycogen Seeds/Dow Agro Pioneer Hi-Bred/Dupont | 68467-2 29964-3 |
| moCry1F corn Event DAS-Ø6275-8 PC Code 006491 OECD Unique Identifier DAS-Ø6275-8 | Mycogen Seeds/Dow Agro | 68467-4 |
| Cry9C Corn | Aventis StarLink | 264-669 |
| Cry3Bb1 corn Event MON863 PC Code 006484 OECD Unique Identifier MON-ØØ863-5 | Monsanto YielGard RW | 524-528 |
| Cry3Bb1 corn Event MON 88017 PC Code 006498 OECD Unique Identifier MON-88Ø17-3 | Monsanto YieldGrad VT Rootworm | 524-551 |
| Cry34Ab1/Cry35Ab1 corn Event DAS-591227-7 PC Code 006490 OECD Unique Identifier DAS-59122-7 | Mycogen Seeds/Dow Agro Pioneer Hi-Bred/Dupont Herculex Rootworm | 68467-5 29964-4 |
| Cry34Ab1/Cry35Ab1 and Cry1F corn Event 4114 PC Codes 006555, 006556 | Pioneer Hi-Bred/Dupont | 29964-17 |
| mCry3A corn Event MIR 604 PC Code 006509 OECD Unique Identifier SYN-IR604-8 | Syngenta Seeds Agrisure RW | 67979-5 |
| Cry1A.105 and Cry2Ab2 corn Event MON 89034 PC Codes 006515 and 006514 | Monsanto Genuity VT Double Pro | 524-575 |
| Vip3Aa20 corn Event MIR 162 PC Code 006599 OECD Unique Identifier SYN-IR162-4 | Syngenta Seeds Agrisure Viptera | 67979-14 |
| eCry3.1Ab corn in Event 5307 PC Code 016483 OECD Unique Identifier SYN-Æ53Æ7-1 | Syngenta | 67979-22 |
| Stacked Events and Seed Blend Corn | | |
| MON863 × MON810 with Cry3Bb1 + Cry1Ab | Monsanto YieldGard Plus | 524-545 |
| DAS-59122-7 × TC1507 with Cry34Ab1/Cry35Ab1 + Cry1F | Mycogen Seeds/Dow Agro Pioneer Hi-Bred/Dupont Herculex Xtra | 68467-6 29964-5 |
| MON 88017 × MON 810 with Cry1AB + Cry3Bb | Monsanto YieldGard VT Triple YieldGard VT Plus | 524-552 |
| MIR 604 × Bt11 with mCry3A + Cry1Ab | Syngenta Agrisure CB/RW Agrisure 3000GT | 67979-8 |
| Mon 89034 × Mon 88017 with Cry1A.105 + Cry2Ab2 + Cry3Bb1 | Monsanto Genuity VT Triple PRO | 524-576 |
| Bt11 × MIR 162 with Cry1Ab + Vip3Aa 20 | Syngenta Seeds Agrisure 2100 | 67979-12 |
| Bt11 × MIR 162 × MIR 604 with Cry1Ab + Vip3Aa20 + mCry3A | Syngenta Seeds Agrisure 3100 | 67979-13 |
| MON 89034 × TC1507 × MON 88017 × DAS-59122-7 with Cry1A.105 + Cry2Ab2 + Cry1F + Cry3Bb1 + Cry34Ab1/Cry35Ab1 | Monsanto Company Mycogen Seeds/Dow Agro Genuity SmartStax SmartStax | 524-581 68467-7 |
| MON 89034 × TC1507 × MON 88017 × DAS-59122-7 Seed Blend | Monsanto Company Mycogen Seeds/Dow Agro | 524-595 68467-16 |

TABLE 11-continued

List of exemplary Plant-incorporated Protectants, which can be combined with microbes of the disclosure

| Plant-Incorporated Protectants (PIPs) | Company and Trade Names | Pesticide Registration Numbers |
|---|---|---|
| | Genuity SmartStax RIB Complete SmartStax Refuge Advanced; Refuge Advanced Powered by SmartStax | |
| Seed Blend of Herculex Xtra + Herculex I | Pioneer Hi-Bred/Dupont Optimum AcreMax1 Insect Protection | 29964-6 |
| Seed Blend of Herculex RW + Non-Bt corn | Pioneer Hi-Bred/Dupont Optimum AcreMax RW | 29964-10 |
| (Cry1F × Cry34/35 × Cry1Ab) − seed blend | Pioneer Hi-Bred/Dupont Optimum AcreMax Xtra | 29964-11 |
| (Cry1F × Cry1Ab) − seed blend | Pioneer Hi-Bred/Dupont Optimum AcreMax Insect Protection | 29964-12 |
| (Cry1F × mCry3A) | Pioneer Hi-Bred/Dupont Optimum Trisect | 29964-13 |
| (Cry1F × Cry34/35 × Cry1Ab × mCry3A) | Pioneer Hi-Bred/Dupont Optimum Intrasect Xtreme | 29964-14 |
| 59122 × MON 810 × MIR 604 (Cry34/35 × Cry1Ab × mCry3A) | Pioneer Hi-Bred/Dupont | 29964-15 |
| Optimum AcreMax Xtreme (Cry1F × Cry34/35 × Cry1Ab × mCry3A) − seed blend | Pioneer Hi-Bred/Dupont Optimum AcreMax Xtreme (seed blend) | 29964-16 |
| MON 810 × MIR 604 (Cry1Ab × mCry3A) | Pioneer Hi-Bred/Dupont | 29964-18 |
| 1507 × MON810 × MIR 162 (Cry1F × Cry1Ab × Vip 3Aa20) | Pioneer Hi-Bred/Dupont Optimum Intrasect Leptra | 29964-19 |
| 1507 × MIR 162 (Cry1F × Vip30Aa20) | Pioneer Hi-Bred/Dupont | 29964-20 |
| 4114 × MON 810 × MIR 604 (Cry34/35 × Cry1F × Cry1Ab × mCry3A) − seed blend | Pioneer Hi-Bred/Dupont | 29964-21 |
| 4114 × MON 810 × MIR 604 (Cry34/35 × Cry1F × Cry1Ab × mCry3A) | Pioneer Hi-Bred/Dupont | 29964-22 |
| 1507 × MON810 × MIR 604 (Cry1F × Cry1Ab × mCry3A) − seed blend | Pioneer Hi-Bred/Dupont Optimum AcreMax Trisect | 29964-23 |
| 1507 × MON810 × MIR 604 (Cry1F × Cry1Ab × mCry3A) | Pioneer Hi-Bred/Dupont Optimum Intrasect Trisect | 29964-24 |
| 4114 × MON 810 (Cry34/35 × Cry1F × Cry1Ab) | Pioneer Hi-Bred/Dupont | 29964-25 |
| 1507 × MON810 × MIR 162 (Cry1F × Cry1Ab × Vip 3Aa20) − seed blend | Pioneer Hi-Bred/Dupont Optimum AcreMax Leptra | 29964-26 |
| SmartStax Intermediates (8 products) | Monsanto | 524-583, 524-584, 524-586, 524 -587, 524-588, 524-589, 524-590 |
| MON 89034 × 1507 (Cry1A.105 × Cry2Ab2 × Cry1F) | Monsanto Genuity PowerCore | 524-585 |
| MON 89034 (Cry1A.105 × Cry2Ab2) − seed blend | Monsanto Genuity VT Double PRO RIB Complete | 524-597 |
| MON 89034 × 88017 RIB Complete (Cry1A.105 × Cry2Ab2 × Cry3Bb1) − seed blend | Monsanto Genuity VT Triple PRO RIB Complete | 524-606 |
| MON 89034 × 1507 (Cry1A.105 × Cry2Ab2 × Cry1F) − seed blend | Monsanto Genuity PowerCore RIB Complete | 524-612 |

TABLE 11-continued

List of exemplary Plant-incorporated Protectants, which can be combined with microbes of the disclosure

| Plant-Incorporated Protectants (PIPs) | Company and Trade Names | Pesticide Registration Numbers |
|---|---|---|
| Bt11 × MIR162 × 1507 (Cry1Ab × Vip3Aa20 × Cry1F) | Syngenta Seeds Agrisure Viptera 3220 Refuge Renew | 67979-15 |
| Bt11 × 59122-7 × MIR 604 × 1507 (Cry1Ab × Cry34/35 × mCry3A × Cry1F) | Syngenta Seeds Agrisure 3122 | 67979-17 |
| Bt11 × MIR162 × TC1507 (Cry1Ab × Vip3Aa20 × Cry1F) – seed blend | Syngenta Seeds Agisure Viptera 3220 (E-Z Refuge) (Refuge Advanced) | 67979-19 |
| Bt11 × DAS 59122-7 × MIR604 × TC1507 (Cry1Ab × Cry34/35 × mCry3A × Cry1F) – seed blend | Syngenta Seeds Agisure Viptera 3122 (E-Z Refuge) (Refuge Advanced) | 67979-20 |
| Bt11 × MIR 162 × MIR 604 × TC1507 × 5307 (Cry1Ab × Vip3Aa20 × mCry3A × Cry1F × eCry3.1Ab) | Syngenta Seeds Agrisure Duracade (Refuge Renew) 5222 | 67979-23 |
| Bt11 × MIR 604 × TC1507 × 5307 (Cry1Ab × mCry3A × Cry1F × eCry3.1Ab) | Syngenta Seeds Agrisure Duracade (Refuge Renew) 5122 | 67979-24 |
| Bt11 × MIR 604 × TC1507 × 5307 (Cry1Ab × mCry3A × Cry1F × eCry3.1Ab) – seed blend | Syngenta Seeds Agisure Duracade 5122 E-Z Refuge | 67979-25 |
| Bt11 × MIR 162 × MIR 604 × TC1507 × 5307 (Cry1Ab × Vip3Aa20 × mCry3A × Cry1F × eCry3.1Ab) – seed blend | Syngenta Seeds Agisure Duracade 5222 E-Z Refuge | 67979-26 |
| Bt11 × MIR 162 × MIR 604 × TC1507 × 5307 (Cry1Ab × Vip3Aa20 × mCry3A × Cry1F × eCry3.1Ab) | Syngenta Seeds Agrisure Duracade (Refuge Renew) 5022 | 67979-27 |
| MIR604 × DAS-59122-7 × TC1507 (mCry3A × Cry34/35 × Cry1F) | Syngenta Seeds | 67979-29 |
| SmartStax Intermediates (8 products) | Mycogen Seeds/Dow Agro | 68467-8, 68467-9, 68467-10, 68467-11, 68467-13, 68467-14, 68467-15 |
| MON 89034 × 1507 (Cry1A.105 × Cry2Ab2 × Cry1F) | Mycogen Seeds/Dow Agro PowerCore; PowerCore Enlist | 68467-12 |
| MON 89034 × 1507 (Cry1A.105 × Cry2Ab2 × Cry1F) – seed blend | Mycogen Seeds/Dow Agro PowerCore Refuge Advanced; Refuge Advanced Powered by PowerCore | 68467-21 |
| 1507 × MON 810 | Pioneer Hi-Bred/Dupont Optimum Intrasect | 29964-7 |
| 59122 × 1507 × MON 810 | Pioneer Hi-Bred/Dupont | 29964-8 |
| 59122 × MON 810 | Pioneer Hi-Bred/Dupont | 29964-9 |
| Cotton | | |
| Cry1Ac Cotton | Monsanto BollGard | 524-478 |
| Cry1Ac and Cry2Ab2 in Event 15985 Cotton PC Codes 006445, 006487 | Monsanto BollGard II | 524-522 |
| Bt cotton Event MON531 with Cry1Ac (breeding nursery use only) | Monsanto | 524-555 |
| Bt cotton Event MON15947 with Cry2Ab2 (breeding nursery use only) | Monsanto | 524-556 |
| COT102 × MON 15985 (Vip3Aa19 × Cry1Ac × Cry2Ab2) | Monsanto Bollgard III | 524-613 |
| Cry1F and Cry1Ac (Events DAS-21023-5 × DAS-24236-5) Cotton PC Codes 006512, 006513 | Mycogen Seeds/Dow Agro Widestrike | 68467-3 |
| Event 3006-210-23 (Cry1Ac) | Mycogen Seeds/Dow Agro | 68467-17 |
| Event 281-24-236 (Cry1F) | Mycogen Seeds/Dow Agro | 68467-18 |
| WideStrike × COT102 (Cry1F × Cry1Ac × Vip3Aa19) | Mycogen Seeds/Dow Agro WideStrike 3 | 68467-19 |

TABLE 11-continued

List of exemplary Plant-incorporated Protectants, which can be combined with microbes of the disclosure

| Plant-Incorporated Protectants (PIPs) | Company and Trade Names | Pesticide Registration Numbers |
|---|---|---|
| Vip3Aa19 and FLCry1Ab (Events Cot102 × Cot67B) Cotton PC Codes 016484, 016486 OECD Unique Identifier SYN-IR102-7 × SYN-IR67B-1 | Syngenta Seeds (Formally VipCot) | 67979-9 |
| COT102 (Vip3Aa19) | Syngenta Seeds | 67979-18 |
| COT67B (FLCry1Ab) | Syngenta Seeds | 67979-21 |
| T304-40 (Cry1Ab) | Bayer CropScience | 264-1094 |
| GHB119 (Cry2Ae) | Bayer CropScience | 264-1095 |
| T304-40 × GHB119 (Cry1Ab × Cry2Ae) | Bayer CropScience TwinLink | 264-1096 |
| OECD Unique Identifier: BCS-GHØØ4-7 × BCS-GHØØ5-8 | | |
| Soybean | | |
| Cry1Ac in Event 87701 Soybean PC Code 006532 OECD Unique Identifier | Monsanto Inacta | 524-594 |
| Cry1A.105 and Cry2Ab2 in Event 87751 Soybean PC Codes 006614, 006615 OECD Unique Identifier MON-87751-7 | Monsanto | 524-619 |
| Cry1Ac × Cry1F in Event DAS 81419 Soybean PC Codes 006527, 006528 OECD Unique Identifier DAS 81419 (Cry1Ac × Cry1F) | Mycogen Seeds/Dow Agro | 68467-20 |

In some embodiments, any one or more of the pesticides set forth herein may be utilized with any one or more of the microbes of the disclosure and can be applied to plants or parts thereof, including seeds.

Herbicides

As aforementioned, agricultural compositions of the disclosure, which may comprise any microbe taught herein, are sometimes combined with one or more herbicides.

Compositions comprising bacteria or bacterial populations produced according to methods described herein and/or having characteristics as described herein may further include one or more herbicides. In some embodiments, herbicidal compositions are applied to the plants and/or plant parts. In some embodiments, herbicidal compositions may be included in the compositions set forth herein, and can be applied to a plant(s) or a part(s) thereof simultaneously or in succession, with other compounds.

Herbicides include 2,4-D, 2,4-DB, acetochlor, acifluorfen, alachlor, ametryn, atrazine, aminopyralid, benefin, bensulfuron, bensulide, bentazon, bicyclopyrone, bromacil, bromoxynil, butylate, carfentrazone, chlorimuron, chlorsulfuron, clethodim, clomazone, clopyralid, cloransulam, cycloate, DCPA, desmedipham, dicamba, dichlobenil, diclofop, diclosulam, diflufenzopyr, dimethenamid, diquat, diuron, DSMA, endothall, EPIC, ethalfluralin, ethofumesate, fenoxaprop, fluazifop-P, flucarbzone, flufenacet, flumetsulam, flumiclorac, flumioxazin, fluometuron, fluroxypyr, fomesafen, foramsulfuron, glufosinate, glyphosate, halosulfuron, hexazinone, imazamethabenz, imazamox, imazapic, imazaquin, imazethapyr, isoxaflutole, lactofen, linuron, MCPA, MCPB, mesotrione, metolachlor-s, metribuzin, indaziflam, metsulfuron, molinate, MSMA, napropamide, naptalam, nicosulfuron, norflurazon, oryzalin, oxadiazon, oxyfluorfen, paraquat, pelargonic acid, pendimethalin, phenmedipham, picloram, primisulfuron, prodiamine, prometryn, pronamide, propanil, prosulfuron, pyrazon, pyrithioac, quinclorac, quizalofop, rimsulfuron, S-metolachlor, sethoxydim, siduron, simazine, sulfentrazone, sulfometuron, sulfosulfuron, tebuthiuron, tembotrione, terbacil, thiazopyr, thifensulfuron, thiobencarb, topramezone, tralkoxydim, triallate, triasulfuron, tribenuron, triclopyr, trifluralin, and triflusulfuron.

In some embodiments, any one or more of the herbicides set forth herein may be utilized with any one or more of the plants or parts thereof set forth herein.

Herbicidal products may include CORVUS, BALANCE FLEXX, CAPRENO, DIFLEXX, LIBERTY, LAUDIS, AUTUMN SUPER, and DIFLEXX DUO.

In some embodiments, any one or more of the herbicides set forth in the below Table 12 may be utilized with any one or more of the microbes taught herein, and can be applied to any one or more of the plants or parts thereof set forth herein.

TABLE 12

List of exemplary herbicides, which can be combined with microbes of the disclosure

| Site of Action | Herbicide Group Number | Chemical Family | Herbicide |
|---|---|---|---|
| ACCase inhibitors | 1 | Cyclohexanediones | Sethoxydim (Poast, Poast Phis) |
| | | | Clethodim (Select, Select Max, Arrow) |
| | | Aryloxyphenoxypropionates | Fluazifop (Fusilade DX, component in Fusion) |
| | | | Fenoxaprop (Puma, component in Fusion) |

TABLE 12-continued

List of exemplary herbicides, which can be combined with microbes of the disclosure

| Site of Action | Herbicide Group Number | Chemical Family | Herbicide |
|---|---|---|---|
| | | | Quizalofop (Assure II, Targa) |
| | | Phenylpyrazolins | Pinoxaden (Axial XL) |
| ALS inhibitors | 2 | Imidazolinones | Imazethapyr (Pursuit) |
| | | | Imazamox (Raptor) |
| | | Sulfonylureas | Chlorimuron (Classic) |
| | | | Halosulfuron (Permit, Sanded) |
| | | | Iodosulfuron (component in Autumn Super) |
| | | | Mesosulfuron (Osprey) |
| | | | Nicosulfuron (Accent Q) |
| | | | Primisulfuron (Beacon) |
| | | | Prosulfuron (Peak) |
| | | | Rimsulfuron (Matrix, Resolve) |
| | | | Thifensulfuron (Harmony) |
| | | | Tribenuron (Express) |
| | | | Triflusulfuron (UpBeet) |
| | | Triazolopyrimidine | Flumetsulam (Python) |
| | | | Cloransulam-methyl (FirstRate) |
| | | | Pyroxsulam (PowerFlex HL) |
| | | | Florasulam (component in Quelex) |
| | | Sulfonylamiocarbonyltriazolinones | Propoxycarbazone (Olympus) |
| | | | Thiencarbazone-methyl (component in Capreno) |
| Microtubule inhibitors (root inhibitors) | 3 | Dinitroanilines | Trifluralin (many names) |
| | | | Ethalfluralin (Sonalan) |
| | | | Pendimethalin (Prowl/Prowl $H_2O$) |
| | | Benzamide | Pronamide (Kerb) |
| Synthetic auxins | 4 | Arylpicolinate | Halauxifen (Elevore, component in Quelex) |
| | | Phenoxy acetic acids | 2,4-D (Enlist One, others) |
| | | | 2,4-DB (Butyrac 200, Butoxone 200) |
| | | | MCPA |
| | | Benzoic acids | Dicamba (Banvel, Clarity, DiFlexx, Eugenia, XtendiMax, component in Status) |
| | | Pyridines | Clopyralid (Stinger) |
| | | | Fluroxypyr (Starane Ultra) |
| Photosystem II inhibitors | 5 | Triazines | Atrazine |
| | | | Simazine (Princep, Sim-Trol) |
| | | Triazinone | Metribuzin (Metribuzin, others) |
| | | | Hexazinone (Velpar) |
| | | Phenyl-carbamates | Desmedipham (Betenex) |
| | | | Phenmedipham (component in Betamix) |
| | | Uracils | Terbacil (Sinbar) |
| | 6 | Benzothiadiazoles | Bentazon (Basagran, others) |
| | | Nitriles | Bromoxynil (Buctril, Moxy, others) |
| | 7 | Phenylureas | Linuron (Lorox, Linex) |
| Lipid synthesis inhibitor | 8 | Thiocarbamates | EPTC (Eptam) |
| EPSPS inhibitor | 9 | Organophosphorus | Glyphosate |
| Glutamine synthetase inhibitor | 10 | Organophosphorus | Glufosinate (Liberty, Rely) |

TABLE 12-continued

List of exemplary herbicides, which can be combined with microbes of the disclosure

| Site of Action | Herbicide Group Number | Chemical Family | Herbicide |
|---|---|---|---|
| Diterpene biosynthesis inhibitor (bleaching) | 13 | Isoxazolidinone | Clomazone (Command) |
| Protoporphyrinogen oxidase inhibitors (PPO) | 14 | Diphenylether | Acifluorfen (Ultra Blazer) |
| | | | Fomesafen (Flexstar, Reflex) |
| | | | Lactofen (Cobra, Phoenix) |
| | | N-phenylphthalimide | Flumiclorac (Resource) |
| | | | Flumioxazin (Valor, Valor EZ, Rowel) |
| | | Aryl triazolinone | Sulfentrazone (Authority, Spartan) |
| | | | Carfentrazone (Aim) |
| | | | Fluthiacet-methyl (Cadet) |
| | | Pyrazoles | Pyraflufen-ethyl (Vida) |
| | | Pyrimidinedione | Saflufenacil (Sharpen) |
| Long-chain fatty acid inhibitors | 15 | Acetamides | Acetochlor (Harness, Surpass NXT, Breakfree NXT, Warrant) |
| | | | Dimethenamid-P (Outlook) |
| | | | Metolachlor (Parallel) |
| | | | Pyroxasulfone (Zidua, Zidua SC) |
| | | | s-metolachlor (Dual Magnum, Dual II Magnum, Cinch) |
| | | | Flufenacet (Define) |
| Specific site unknown | 16 | Benzofuranes | Ethofumesate (Nortron) |
| Auxin transport inhibitor | 19 | Semicarbazone | diflufenzopyr (component in Status) |
| Photosystem I inhibitors | 22 | Bipyridiliums | Paraquat (Gramoxone, Parazone) |
| | | | Diquat (Reglone) |
| 4-HPPD inhibitors (bleaching) | 27 | Isoxazole | Isoxaflutole (Balance Flexx) |
| | | Pyrazole | Pyrasulfotole (component in Huskie) |
| | | Pyrazolone | Topramezone (Armezo/Impact) |
| | | Triketone | Bicyclopyrone (component in Acuron) |
| | | | Mesotrione (Callisto) |
| | | | Tembotrione (Laudis) |

Fungicides

As aforementioned, agricultural compositions of the disclosure, which may comprise any microbe taught herein, are sometimes combined with one or more fungicides.

Compositions comprising bacteria or bacterial populations produced according to methods described herein and/or having characteristics as described herein may further include one or more fungicides. In some embodiments, fungicidal compositions may be included in the compositions set forth herein, and can be applied to a plant(s) or a part(s) thereof simultaneously or in succession, with other compounds. The fungicides include azoxystrobin, captan, carboxin, ethaboxam, fludioxonil, mefenoxam, fludioxonil, thiabendazole, thiabendaz, ipconazole, mancozeb, cyazofamid, zoxamide, metalaxyl, PCNB, metaconazole, pyraclostrobin, *Bacillus subtilis* strain QST 713, sedaxane, thiamethoxam, fludioxonil, thiram, tolclofos-methyl, trifloxystrobin, *Bacillus subtilis* strain MBI 600, pyraclostrobin, fluoxastrobin, *Bacillus pumilus* strain QST 2808, chlorothalonil, copper, flutriafol, fluxapyroxad, mancozeb, gludioxonil, penthiopyrad, triazole, propiconaozole, prothioconazole, tebuconazole, fluoxastrobin, pyraclostrobin, picoxystrobin, qols, tetraconazole, trifloxystrobin, cyproconazole, flutriafol, SDHI, EBDCs, sedaxane, MAXIM QUATTRO (gludioxonil, mefenoxam, azoxystrobin, and thiabendaz), RAXIL (tebuconazole, prothioconazole, metalaxyl, and ethoxylated tallow alkyl amines), and benzovindiflupyr.

In some embodiments, any one or more of the fungicides set forth herein may be utilized with any one or more of the plants or parts thereof set forth herein.

Nematicides

As aforementioned, agricultural compositions of the disclosure, which may comprise any microbe taught herein, are sometimes combined with one or more nematicides.

Compositions comprising bacteria or bacterial populations produced according to methods described herein and/or having characteristics as described herein may further include one or more nematicide. In some embodiments, nematicidal compositions may be included in the compositions set forth herein, and can be applied to a plant(s) or a part(s) thereof simultaneously or in succession, with other compounds. The nematicides may be selected from D-D, 1,3-dichloropropene, ethylene dibromide, 1,2-dibromo-3-chloropropane, methyl bromide, chloropicrin, metam sodium, dazomet, methylisothiocyanate, sodium tetrathiocarbonate, aldicarb, aldoxycarb, carbofuran, oxamyl, ethoprop, fenamiphos, cadusafos, fosthiazate, terbufos, fensulfothion, phorate, DiTera, clandosan, sincocin, methyl iodide, propargyl bromide, 2,5-dihydroxymethyl-3,4-dihydroxypyrrolidine (DMDP), any one or more of the avermectins, sodium azide, furfural, Bacillusfirmus, abamectrin, thiamethoxam, fludioxonil, clothiandin, salicylic acid, and benzo-(1,2,3)-thiadiazole-7-carbothioic acid S-methyl ester.

In some embodiments, any one or more of the nematicides set forth herein may be utilized with any one or more of the plants or parts thereof set forth herein.

In some embodiments, any one or more of the nematicides, fungicides, herbicides, insecticides, and/or pesticides set forth herein may be utilized with any one or more of the plants or parts thereof set forth herein.

Fertilizers, Nitrogen Stabilizers, and Urease Inhibitors

As aforementioned, agricultural compositions of the disclosure, which may comprise any microbe taught herein, are sometimes combined with one or more of a: fertilizer, nitrogen stabilizer, or urease inhibitor.

In some embodiments, fertilizers are used in combination with the methods and bacteria of the present disclosure. Fertilizers include anhydrous ammonia, urea, ammonium nitrate, and urea-ammonium nitrate (UAN) compositions, among many others. In some embodiments, pop-up fertilization and/or starter fertilization is used in combination with the methods and bacteria of the present disclosure.

In some embodiments, nitrogen stabilizers are used in combination with the methods and bacteria of the present disclosure. Nitrogen stabilizers include nitrapyrin, 2-chloro-6-(trichloromethyl) pyridine, N-SERVE 24, INSTINCT, dicyandiamide (DCD).

In some embodiments, urease inhibitors are used in combination with the methods and bacteria of the present disclosure. Urease inhibitors include N-(n-butyl)-thiophosphoric triamide (NBPT), AGROTAIN, AGROTAIN PLUS, and AGROTAIN PLUS SC. Further, the disclosure contemplates utilization of AGROTAIN ADVANCED 1.0, AGROTAIN DRI-MAXX, and AGROTAIN ULTRA.

Further, stabilized forms of fertilizer can be used. For example, a stabilized form of fertilizer is SUPER U, containing 46% nitrogen in a stabilized, urea-based granule, SUPERU contains urease and nitrification inhibitors to guard from denitrification, leaching, and volatilization. Stabilized and targeted foliar fertilizer such as NITAMIN may also be used herein.

Pop-up fertilizers are commonly used in corn fields. Pop-up fertilization comprises applying a few pounds of nutrients with the seed at planting. Pop-up fertilization is used to increase seedling vigor.

Slow- or controlled-release fertilizer that may be used herein entails: A fertilizer containing a plant nutrient in a form which delays its availability for plant uptake and use after application, or which extends its availability to the plant significantly longer than a reference 'rapidly available nutrient fertilizer' such as ammonium nitrate or urea, ammonium phosphate or potassium chloride. Such delay of initial availability or extended time of continued availability may occur by a variety of mechanisms. These include controlled water solubility of the material by semi-permeable coatings, occlusion, protein materials, or other chemical forms, by slow hydrolysis of water-soluble low molecular weight compounds, or by other unknown means.

Stabilized nitrogen fertilizer that may be used herein entails: A fertilizer to which a nitrogen stabilizer has been added. A nitrogen stabilizer is a substance added to a fertilizer which extends the time the nitrogen component of the fertilizer remains in the soil in the urea-N or ammoniacal-N form.

Nitrification inhibitor that may be used herein entails: A substance that inhibits the biological oxidation of ammoniacal-N to nitrate-N. Some examples include: (1) 2-chloro-6-(trichloromethyl-pyridine), common name Nitrapyrin, manufactured by Dow Chemical; (2) 4-amino-1,2,4-6-triazole-HCl, common name ATC, manufactured by Ishihada Industries; (3) 2,4-diamino-6-trichloro-methyltriazine, common name CI-1580, manufactured by American Cyanamid; (4) Dicyandiamide, common name DCD, manufactured by Showa Denko; (5) Thiourea, common name TU, manufactured by Nitto Ryuso; (6) 1-mercapto-1,2,4-triazole, common name MT, manufactured by Nippon; (7) 2-amino-4-chloro-6-methyl-pyramidine, common name AM, manufactured by Mitsui Toatsu; (8) 3,4-dimethylpyrazole phosphate (DMPP), from BASF; (9) 1-amide-2-thiourea (ASU), from Nitto Chemical Ind.; (10) Ammoniumthiosulphate (ATS); (11) 1H-1,2,4-triazole (HPLC); (12) 5-ethylene oxide-3-trichloro-methly1,2,4-thiodiazole (Terrazole), from Olin Mathieson; (13) 3-methylpyrazole (3-MP); (14) 1-carbamoyle-3-methyl-pyrazole (CMP); (15) Neem; and (16) DMPP.

Urease inhibitor that may be used herein entails: A substance that inhibits hydrolytic action on urea by the enzyme urease. Thousands of chemicals have been evaluated as soil urease inhibitors (Kiss and Simihaian, 2002). However, only a few of the many compounds tested meet the necessary requirements of being nontoxic, effective at low concentration, stable, and compatible with urea (solid and solutions), degradable in the soil and inexpensive. They can be classified according to their structures and their assumed interaction with the enzyme urease (Watson, 2000, 2005). Four main classes of urease inhibitors have been proposed: (a) reagents which interact with the sulphydryl groups (sulphydryl reagents), (b) hydroxamates, (c) agricultural crop protection chemicals, and (d) structural analogues of urea and related compounds. N-(n-Butyl) thiophosphoric triamide (NBPT), phenylphosphorodiamidate (PPD/PPDA), and hydroquinone are probably the most thoroughly studied urease inhibitors (Kiss and Simihaian, 2002). Research and practical testing has also been carried out with N-(2-nitrophenyl) phosphoric acid triamide (2-NPT) and ammonium thiosulphate (ATS). The organo-phosphorus compounds are structural analogues of urea and are some of the most effective inhibitors of urease activity, blocking the active site of the enzyme (Watson, 2005).

Insecticidal Seed Treatments (ISTs) for Corn

Corn seed treatments normally target three spectrums of pests: nematodes, fungal seedling diseases, and insects.

Insecticide seed treatments are usually the main component of a seed treatment package. Most corn seed available today comes with a base package that includes a fungicide and insecticide. In some aspects, the insecticide options for seed treatments include PONCHO (clothianidin), CRUISER/CRUISER EXTREME (thiamethoxam) and GAUCHO (Imidacloprid). All three of these products are neonicotinoid chemistries. CRUISER and PONCHO at the 250 (0.25 mg AI/seed) rate are some of the most common base options available for corn. In some aspects, the insecticide options for treatments include CRUISER 250 thiamethoxam, CRUISER 250 (thiamethoxam) plus LUMIVIA (chlorantraniliprole), CRUISER 500 (thiamethoxam), and PONCHO VOTIVO 1250 (Clothianidin & *Bacillus firmus* I-1582).

Pioneer's base insecticide seed treatment package consists of CRUISER 250 with PONCHO/VOTIVO 1250 also available. VOTIVO is a biological agent that protects against nematodes.

Monsanto's products including corn, soybeans, and cotton fall under the ACCELERON treatment umbrella. Dekalb corn seed comes standard with PONCHO 250. Producers also have the option to upgrade to PONCHO/VOTIVO, with PONCHO applied at the 500 rate.

Agrisure, Golden Harvest and Garst have a base package with a fungicide and CRUISER 250. AVICTA complete corn is also available; this includes CRUISER 500, fungicide, and nematode protection. CRUISER EXTREME is another option available as a seed treatment package, however; the amounts of CRUISER are the same as the conventional CRUISER seed treatment, i.e. 250, 500, or 1250.

Another option is to buy the minimum insecticide treatment available, and have a dealer treat the seed downstream.

Commercially available ISTs for corn are listed in the below Table 13 and can be combined with one or more of the microbes taught herein.

TABLE 13

List of exemplary seed treatments, including ISTs, which can be combined with microbes of the disclosure

| Treatment Type | Active Ingredient(s) | Product Trade Name | Crop |
|---|---|---|---|
| F | azoxystrobin | DYNASTY | Corn, Soybean |
| | | PROTÉGÉ FL | Corn |
| F | *Bacillus pumilus* | YIELD SHIELD | Corn, Soybean |
| F | *Bacillus subtilis* | HISTICK N/T | Soybean |
| | | VAULT HP | Corn, Soybean |
| F | Captan | CAPTAN 400 | Corn, Soybean |
| | | CAPTAN 400-C | Corny Soybean |
| F | Fludioxonil | MAXIM 4FS | Corn, Soybean |
| F | Hydrogen peroxide | OXIDATE | Soybean |
| | | STOROX | Soybean |
| F | ipconazole | ACCELERON DC-5 09 | Corn |
| | | RANCONA 3.8 FS | Corn, Soybean |
| | | VORTEX | Corn |
| F | mancozeb | BONIDE MANCOZEB w/Zinc Concentrate | Corn |
| | | DITHANE 75DF RAINSHIELD | Corn |
| | | DITHANE DF RAINSHIELD | Corn |
| | | DITHANE F45 RAINSHIELD | Corn |
| | | DITHANE M45 | Corn |
| | | LESCO 4 FLOWABLE MANCOZEB | Corn |
| | | PENNCOZEB 4FL FLOWABLE | Corn |
| | | PENNCOZEB 75DF DRY FLOWABLE | Corn |
| | | PENNCOZEB 80WP | Corn |
| F | mefenoxam | APRON XL | Corn, Soybean |
| F | metalaxyl | ACCELERON DC-309 | Corn |
| | | ACCELERON DX-309 | Corn, Soybean |
| | | ACQUIRE | Corn, Soybean |
| | | AGRI STAR METALAXYL 265 ST | Corn, Soybean |
| | | ALLEGIANCE DRY | Corn, Soybean |
| | | ALLEGIANCE FL | Corn, Soybean |
| | | BELMONT 2.7 FS | Corn, Soybean |
| | | DYNA-SHIELD METALAXYL | Corn, Soybean |
| | | SEBRING 2.65 ST | Corn, Soybean |
| | | SEBRING 318 FS | Corn, Soybean |
| | | SEBRING 480 FS | Corn, Soybean |
| | | VIREO MEC | Soybean |
| F | pyraclostrobin | ACCELERON DX-109 | Soybean |
| | | STAMINA | Corn |
| F | *Streptomyces griseoviridis* | MYCOSTOP | Corn, Soybean |
| F | *Streptomyces lydicus* | ACTINOGROW ST | Corn, Soybean |
| F | tebuconazole | AMTIDE TEBU 3.6F | Corn |
| | | SATIVA 309 FS | Corn |
| | | SATIVA 318 FS | Corn |
| | | TEBUSHA 3.6FL | Corn |
| | | TEBUZOL 3.6F | Corn |
| F | thiabendazole | MERTECT 340-F | Soybean |
| F | thiram | 42-S THIRAM | Corn, Soybean |
| | | FLOWSAN | Corn, Soybean |
| | | SIGNET 480 FS | Corn, Soybean |
| F | *Trichoderma harzianum Rifai* | T-22 HC | Corn, Soybean |
| F | trifloxystrobin | ACCELERON DX-709 | Corn |
| | | TRILEX FLOWABLE | Corn, soybean |
| I | chlorpyrifos | LORSBAN 50W in water soluble packets | Corn |
| I | clothianidin | ACCELERON IC-609 | Corn |
| | | NIPSIT INSIDE | Corn, Soybean |
| | | PONCHO 600 | Corn |
| I | imidacloprid | ACCELERON IX-409 | Corn |
| | | AGRI STAR MACHO 600 ST | Corn, Soybean |

TABLE 13-continued

List of exemplary seed treatments, including ISTs, which can be combined with microbes of the disclosure

| Treatment Type | Active Ingredient(s) | Product Trade Name | Crop |
|---|---|---|---|
| | | AGRISOLUTIONS NITRO SHIELD | Corn, Soybean |
| | | ATTENDANT 600 | Corn, Soybean |
| | | AXCESS | Corn, Soybean |
| | | COURAZE 2F | Soybean |
| | | DYNA-SHIELD IMIDACLOPRID 5 | Corn, Soybean |
| | | GAUCHO 480 FLOWABLE | Corn, Soybean |
| | | GAUCHO 600 FLOWABLE | Corn, Soybean |
| | | GAUCHO SB FLOWABLE | Corn, Soybean |
| | | NUPRID 4.6F PRO | Soybean |
| | | SENATOR 600 FS | Corn, Soybean |
| I | thiamethoxam | CRUISER 5FS | Corn, Soybean |
| N | abamectin | AVICTA 500 FS | Corn, Soybean |
| N | *Bacillus firmus* | VOTIVO FS | Soybean |
| P | cytokinin | SOIL X-CYTO | Soybean |
| | | X-CYTE | Soybean |
| P | harpin alpha beta protein | ACCELERON HX-209 | Corn, Soybean |
| | | N-HIBIT GOLD CST | Corn, Soybean |
| | | N-HIBIT HX-209 | Corn, Soybean |
| P | indole butyric acid | KICKSTAND PGR | Corn, Soybean |
| I, N | thiamethoxam, abamectin | AVICTA DUO CORN | Corn |
| | | AVICTA DUO 250 | |
| I, F | clothianidin, *Bacillus firmus* | PONCHO VOTIVO | Corn, Soybean |
| F, F | carboxin, captan | ENHANCE | Soybean |
| I, F | permethrin, carboxin | KERNEL GUARD SUPREME | Corn, Soybean |
| F, F | carboxin, thiram | VITAFLO 280 | Corn, Soybean |
| F, F | mefenoxam, fludioxonil | MAXIM XL | Corn, Soybean |
| | | WARDEN RTA | Soybean |
| | | APRON MAXX RFC | |
| | | APRON MAXX RTA + MOLY | |
| | | APRON MAXX RTA | |
| I, F | imidacloprid, metalaxyl | AGRISOLUTIONS CONCUR | Corn |
| F, F | metalaxyl, ipconazole | RANCONA SUMMIT | Soybean |
| | | RANCONA XXTRA | |
| F, F | thiram, metalaxyl | PROTECTOR-L-ALLEGIANCE | Soybean |
| F, F | trifloxystrobin, metalaxyl | TRILEX AL | Soybean |
| | | TRILEX 2000 | |
| P, P, P | cytokinin, gibberellic acid, indole butyric acid | STIMULATE YIELD ENHANCER ASCEND | Corn, Soybean |
| F, F, I | mefenoxam, fludioxonil, thiamethoxam | CRUISERMAXX PLUS | Soybean |
| F, F, F | captan, carboxin, metalaxyl | BEAN GUARD/ALLEGIANCE | Soybean |
| F, F, I | captan, carboxin, imidacloprid | ENHANCE AW | Soybean |
| F, F, I | carboxin, metalaxyl, imidacloprid | LATITUDE | Corn, Soybean |
| F, F, F | metalaxyl, pyraclostrobin, triticonazole | STAMENA F3 HL | Corn |
| F, F, F, I | azoxystrobin, fludioxonil, mefenoxam, thiamethoxam | CRUISER EXTREME | Corn |
| F, F, F, F, F | azoxystrobin, fludioxonil, mefenoxam, thiabendazole | MAXIM QUATTRO | Corn |
| I | Chlorantraniliprole | LUMIVIA | Corn |

F = Fungicide;
I = Insecticide;
N = Nematicide;
P = Plant Growth Regulator

Application of Bacterial Populations on Crops

The composition of the bacteria or bacterial population described herein can be applied in furrow, in talc, or as seed treatment. The composition can be applied to a seed package in bulk, mini bulk, in a bag, or in talc.

The planter can plant the treated seed and grows the crop according to conventional ways, twin row, or ways that do not require tilling. The seeds can be distributed using a control hopper or an individual hopper. Seeds can also be distributed using pressurized air or manually. Seed placement can be performed using variable rate technologies. Additionally, application of the bacteria or bacterial population described herein may be applied using variable rate technologies. In some examples, the bacteria can be applied to seeds of corn, soybean, canola, sorghum, potato, rice, vegetables, cereals, pseudocereals, and oilseeds. Examples of cereals may include barley, fonio, oats, palmer's grass, rye, pearl millet, sorghum, spelt, teff, triticale, and wheat. Examples of pseudocereals may include breadnut, buckwheat, cattail, chia, flax, grain amaranth, hanza, *quinoa*, and sesame. In some examples, seeds can be genetically modified organisms (GMO), non-GMO, organic or conventional.

Additives such as micro-fertilizer, PGR, herbicide, insecticide, and fungicide can be used additionally to treat the crops. Examples of additives include crop protectants such as insecticides, nematicides, fungicide, enhancement agents such as colorants, polymers, pelleting, priming, and disinfectants, and other agents such as inoculant, PGR, softener, and micronutrients. PGRs can be natural or synthetic plant hormones that affect root growth, flowering, or stem elongation. PGRs can include auxins, gibberellins, cytokinins, ethylene, and abscisic acid (ABA).

The composition can be applied in furrow in combination with liquid fertilizer. In some examples, the liquid fertilizer may be held in tanks. NPK fertilizers contain macronutrients of sodium, phosphorous, and potassium.

The composition may improve plant traits, such as promoting plant growth, maintaining high chlorophyll content in leaves, increasing fruit or seed numbers, and increasing fruit or seed unit weight. Methods of the present disclosure may be employed to introduce or improve one or more of a variety of desirable traits. Examples of traits that may introduced or improved include: root biomass, root length, height, shoot length, leaf number, water use efficiency, overall biomass, yield, fruit size, grain size, photosynthesis rate, tolerance to drought, heat tolerance, salt tolerance, tolerance to low nitrogen stress, nitrogen use efficiency, resistance to nematode stress, resistance to a fungal pathogen, resistance to a bacterial pathogen, resistance to a viral pathogen, level of a metabolite, modulation in level of a metabolite, proteome expression. The desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the introduced and/or improved traits) grown under identical conditions. In some examples, the desirable traits, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., plants without the introduced and/or improved traits) grown under similar conditions.

An agronomic trait to a host plant may include, but is not limited to, the following: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome, compared to an isoline plant grown from a seed without said seed treatment formulation.

In some cases, plants are inoculated with bacteria or bacterial populations that are isolated from the same species of plant as the plant element of the inoculated plant. For example, an bacteria or bacterial population that is normally found in one variety of *Zea mays* (corn) is associated with a plant element of a plant of another variety of *Zea mays* that in its natural state lacks said bacteria and bacterial populations. In one embodiment, the bacteria and bacterial populations is derived from a plant of a related species of plant as the plant element of the inoculated plant. For example, an bacteria and bacterial populations that is normally found in *Zea diploperennis* Iltis et al., (diploperennial teosinte) is applied to a *Zea mays* (corn), or vice versa. In some cases, plants are inoculated with bacteria and bacterial populations that are heterologous to the plant element of the inoculated plant. In one embodiment, the bacteria and bacterial populations is derived from a plant of another species. For example, bacteria and bacterial populations that are normally found in dicots are applied to a monocot plant (e.g., inoculating corn with a soybean-derived bacteria and bacterial populations), or vice versa. In other cases, the bacteria and bacterial populations to be inoculated onto a plant is derived from a related species of the plant that is being inoculated. In one embodiment, the bacteria and bacterial populations is derived from a related taxon, for example, from a related species. The plant of another species can be an agricultural plant. In another embodiment, the bacteria and bacterial populations is part of a designed composition inoculated into any host plant element.

In some examples, the bacteria or bacterial population is exogenous wherein the bacteria and bacterial population is isolated from a different plant than the inoculated plant. For example, in one embodiment, the bacteria or bacterial population can be isolated from a different plant of the same species as the inoculated plant. In some cases, the bacteria or bacterial population can be isolated from a species related to the inoculated plant.

In some examples, the bacteria and bacterial populations described herein are capable of moving from one tissue type to another. For example, the present disclosure's detection and isolation of bacteria and bacterial populations within the mature tissues of plants after coating on the exterior of a seed demonstrates their ability to move from seed exterior into the vegetative tissues of a maturing plant. Therefore, in one embodiment, the population of bacteria and bacterial populations is capable of moving from the seed exterior into the vegetative tissues of a plant. In one embodiment, the bacteria and bacterial populations that is coated onto the seed of a plant is capable, upon germination of the seed into a vegetative state, of localizing to a different tissue of the plant. For example, bacteria and bacterial populations can be capable of localizing to any one of the tissues in the plant, including: the root, adventitious root, seminal 5 root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the bacteria and bacterial populations is capable of localizing to the root and/or the root hair of the plant. In another embodiment, the bacteria and bacterial populations is capable of localizing to the photosynthetic tissues, for example, leaves and shoots of the plant. In other cases, the bacteria and bacterial populations is localized to the vascular tissues of the plant, for example, in the xylem and phloem. In still another embodiment, the bacteria and bacterial populations is capable of localizing to the reproductive tissues (flower, pollen, pistil, ovaries, stamen, fruit) of the plant. In another embodiment, the bacteria and bacterial populations is capable of localizing to the root, shoots, leaves and reproductive tissues of the plant. In still another embodiment, the bacteria and bacterial populations colonizes a fruit or seed tissue of the plant. In still another embodiment, the bacteria and bacterial populations is able to colonize the plant such that it is present in the surface of the plant (i.e., its presence is detectably present on the plant exterior, or the episphere of the plant). In still other embodiments, the bacteria and bacterial populations is capable of localizing to substantially all, or all, tissues of the plant. In certain embodiments, the bacteria and bacterial populations is not localized to the root of a plant. In other cases, the bacteria and bacterial populations is not localized to the photosynthetic tissues of the plant.

The effectiveness of the compositions can also be assessed by measuring the relative maturity of the crop or the crop heating unit (CHU). For example, the bacterial population can be applied to corn, and corn growth can be assessed according to the relative maturity of the corn kernel or the time at which the corn kernel is at maximum weight. The crop heating unit (CHU) can also be used to predict the maturation of the corn crop. The CHU determines the amount of heat accumulation by measuring the daily maximum temperatures on crop growth.

In examples, bacterial may localize to any one of the tissues in the plant, including: the root, adventitious root, seminal root, root hair, shoot, leaf, flower, bud tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In another embodiment, the bacteria or bacterial population is capable of localizing to the photosynthetic tissues, for example, leaves and shoots of the plant. In other cases, the bacteria and bacterial populations is localized to the vascular tissues of the plant, for example, in the xylem and phloem. In another embodiment, the bacteria or bacterial population is capable of localizing to reproductive tissues (flower, pollen, pistil, ovaries, stamen, or fruit) of the plant. In another embodiment, the bacteria and bacterial populations is capable of localizing to the root, shoots, leaves and reproductive tissues of the plant. In another embodiment, the bacteria or bacterial population colonizes a fruit or seed tissue of the plant. In still another embodiment, the bacteria or bacterial population is able to colonize the plant such that it is present in the surface of the plant. In another embodiment, the bacteria or bacterial population is capable of localizing to substantially all, or all, tissues of the plant. In certain embodiments, the bacteria or bacterial population is not localized to the root of a plant. In other cases, the bacteria and bacterial populations is not localized to the photosynthetic tissues of the plant.

The effectiveness of the bacterial compositions applied to crops can be assessed by measuring various features of crop growth including, but not limited to, planting rate, seeding vigor, root strength, drought tolerance, plant height, dry down, and test weight.

Plant Species

The methods and bacteria described herein are suitable for any of a variety of plants, such as plants in the genera *Hordeum, Oryza, Zea*, and Triticeae. Other non-limiting examples of suitable plants include mosses, lichens, and algae. In some cases, the plants have economic, social and/or environmental value, such as food crops, fiber crops, oil crops, plants in the forestry or pulp and paper industries, feedstock for biofuel production and/or ornamental plants. In some examples, plants may be used to produce economically valuable products such as a grain, a flour, a starch, a syrup, a meal, an oil, a film, a packaging, a nutraceutical product, a pulp, an animal feed, a fish fodder, a bulk material for industrial chemicals, a cereal product, a processed human-food product, a sugar, an alcohol, and/or a protein. Non-limiting examples of crop plants include maize, rice, wheat, barley, sorghum, millet, oats, rye triticale, buckwheat, sweet corn, sugar cane, onions, tomatoes, strawberries, and asparagus. In some embodiments, the methods and bacteria described herein are suitable for any of a variety of transgenic plants, non-transgenic plants, and hybrid plants thereof.

In some examples, plants that may be obtained or improved using the methods and composition disclosed herein may include plants that are important or interesting for agriculture, horticulture, biomass for the production of biofuel molecules and other chemicals, and/or forestry. Some examples of these plants may include pineapple, banana, coconut, lily, grasspeas and grass; and dicotyledonous plants, such as, for example, peas, alfalfa, tomatillo, melon, chickpea, chicory, clover, kale, lentil, soybean, tobacco, potato, sweet potato, radish, cabbage, rape, apple trees, grape, cotton, sunflower, thale cress, canola, citrus (including orange, mandarin, kumquat, lemon, lime, grapefruit, tangerine, tangelo, citron, and pomelo), pepper, bean, lettuce, *Panicum virgatum* (switch), *Sorghum bicolor* (sorghum, sudan), *Miscanthus giganteus* (*miscanthus*), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp. Sorghum spp., *Miscanthus* spp., *Saccharum* spp., Erianthus spp., *Populus* spp., *Secale cereale* (rye), Salix spp. (willow), *Eucalyptus* spp. (*eucalyptus*), Triticosecale spp. (*triticum*-25 wheat× rye), Bamboo, Carthamus tinctorius (safflower), Jatropha curcas (Jatropha), *Ricinus communis* (castor), *Elaeis guineensis* (oil palm), *Phoenix dactylifera* (date palm), *Archontophoenix cunninghamiana* (king palm), *Syagrus romanzoffiana* (queen palm), *Linum usitatissimum* (flax), *Brassica juncea, Manihot esculenta* (cassava), *Lycopersicon esculentum* (tomato), *Lactuca* saliva (lettuce), Musa paradisiaca (banana), *Solanum tuberosum* (potato), *Brassica oleracea* (broccoli, cauliflower, brussel sprouts), *Camellia sinensis* (tea), Fragaria *ananassa* (strawberry), *Theobroma cacao* (cocoa), *Coffea arabica* (coffee), *Vitis vinifera* (grape), *Ananas comosus* (pineapple), *Capsicum* annum (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis saliva, Camptotheca acuminate, Catharanthus roseus, Vinca rosea, Cinchona officinalis, Coichicum autumnale, Veratrum californica, Digitalis lanata, Digitalis purpurea, Dioscorea* 5 spp., *Andrographis paniculata, Atropa belladonna, Datum stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (*petunia*), *Poinsettia pulcherrima* (poinsettia), *Nicotiana tabacum* (tobacco), *Lupinus albus* (lupin), *Uniola paniculata* (oats), *Hordeum vulgare* (barley), and *Lolium* spp. (rye).

In some examples, a monocotyledonous plant may be used. Monocotyledonous plants belong to the orders of the Alismatales, Arales, Arecales, Bromeliales, Commelinales, Cyclanthales, Cyperales, Eriocaulales, Hydrocharitales, Juncales, Lilliales, Najadales, Orchidales, Pandanales, Poales, Restionales, Triuridales, Typhales, and Zingiberales. Plants belonging to the class of the Gymnospermae are Cycadales, Ginkgoales, Gnetales, and Pinales. In some examples, the monocotyledonous plant can be selected from the group consisting of a maize, rice, wheat, barley, and sugarcane.

In some examples, a dicotyledonous plant may be used, including those belonging to the orders of the Aristochiales, Asterales, Batales, Campanulales, Capparales, Caryophyllales, Casuarinales, Celastrales, Comales, Diapensales, Dilleniales, Dipsacales, Ebenales, Ericales, Eucomiales, Euphorbiales, Fabales, Fagales, Gentianales, Geraniales, Haloragales, Hamamelidales, Middles, Juglandales, Lamiales, Laurales, Lecythidales, Leitneriales, Magniolales, Malvales, Myricales, Myrtales, Nymphaeales, Papeverales, Piperales, Plantaginales, Plumb aginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Theales, Trochodendrales, Umbellales, Urticales, and Violates. In some examples, the dicotyledonous plant can be selected from the group consisting of cotton, soybean, pepper, and tomato.

In some cases, the plant to be improved is not readily amenable to experimental conditions. For example, a crop plant may take too long to grow enough to practically assess an improved trait serially over multiple iterations. Accordingly, a first plant from which bacteria are initially isolated, and/or the plurality of plants to which genetically manipulated bacteria are applied may be a model plant, such as a plant more amenable to evaluation under desired conditions. Non-limiting examples of model plants include *Setaria, Brachypodium*, and *Arabidopsis*. Ability of bacteria isolated according to a method of the disclosure using a model plant may then be applied to a plant of another type (e.g. a crop plant) to confirm conferral of the improved trait.

Traits that may be improved by the methods disclosed herein include any observable characteristic of the plant, including, for example, growth rate, height, weight, color, taste, smell, changes in the production of one or more compounds by the plant (including for example, metabolites, proteins, drugs, carbohydrates, oils, and any other compounds). Selecting plants based on genotypic information is also envisaged (for example, including the pattern of plant gene expression in response to the bacteria, or identifying the presence of genetic markers, such as those associated with increased nitrogen fixation). Plants may also be selected based on the absence, suppression or inhibition of a certain feature or trait (such as an undesirable feature or trait) as opposed to the presence of a certain feature or trait (such as a desirable feature or trait).

Non-Genetically Modified Maize

The methods and bacteria described herein are suitable for any of a variety of non-genetically modified maize plants or part thereof. In some aspects, the corn is organic. Furthermore, the methods and bacteria described herein are suitable for any of the following non-genetically modified hybrids, varieties, lineages, etc. In some embodiments, corn varieties generally fall under six categories: sweet corn, flint corn, popcorn, dent corn, pod corn, and flour corn.

Sweet Corn

Yellow su varieties include Earlivee, Early Sunglow, Sundance, Early Golden Bantam, Iochief, Merit, Jubilee, and Golden Cross Bantam. White su varieties include True Platinum, Country Gentleman, Silver Queen, and Stowell's Evergreen. Bicolor su varieties include Sugar & Gold, Quickie, Double Standard, Butter & Sugar, Sugar Dots, Honey & Cream. Multicolor su varieties include Hookers, Triple Play, Painted Hill, Black Mexican/Aztec.

Yellow se varieties include Buttergold, Precocious, Spring Treat, Sugar Buns, Colorow, Kandy King, Bodacious R/M, Tuxedo, Incredible, Merlin, Miracle, and Kandy Korn ER White se varieties include Spring Snow, Sugar Pearl, Whiteout, Cloud Nine, Alpine, Silver King, and Argent. Bicolor se varieties include Sugar Baby, Fleet, Bon Jour, Trinity, Bi-Licious, Temptation, Luscious, *Ambrosia*, Accord, Brocade, Lancelot, Precious Gem, Peaches and Cream Mid EH, and Delectable R/M. Multicolor se varieties include Ruby Queen.

Yellow sh2 varieties include Extra Early Super Sweet, Takeoff, Early Xtra Sweet, Raveline, Summer Sweet Yellow, Krispy King, Garrison, Illini Gold, Challenger, Passion, Excel, Jubilee SuperSweet, Illini Xtra Sweet, and Crisp 'N Sweet. White sh2 varieties include Summer Sweet White, Tahoe, Aspen, Treasure, How Sweet It Is, and Camelot. Bicolor sh2 varieties include Summer Sweet Bicolor, Radiance, Honey 'N Pearl, Aloha, Dazzle, Hudson, and Phenomenal.

Yellow sy varieties include Applause, Inferno, Honeytreat, and Honey Select. White sy varieties include Silver Duchess, *Cinderella*, Mattapoisett, Avalon, and Captivate. Bicolor sy varieties include Pay Dirt, Revelation, Renaissance, *Charisma*, Synergy, Montauk, Kristine, Serendipity/Providence, and Cameo.

Yellow augmented supersweet varieties include Xtra-Tender 1ddA, Xtra-Tender 11dd, Mirai 131Y, Mimi 130Y, Vision, and Mimi 002. White augmented supersweet varieties include Xtra-Tender 3dda, Xtra-Tender 31dd, Mirai 421W, XTH 3673, and Devotion. Bicolor augmented supersweet varieties include Xtra-Tender 2dda, Xtra-Tender 21dd, Kickoff XR, Mimi 308BC, Anthem XR, Mirai 336BC, Fantastic XR, Triumph, Mimi 301BC, Stellar, American Dream, Mimi 350BC, and Obsession.

Flint Corn

Flint corn varieties include Bronze-Orange, Candy Red Flint, Floriani Red Flint, Glass Gem, Indian Ornamental (Rainbow), Mandan Red Flour, Painted Mountain, Pet-mecky, Cherokee White Flour, PopCorn Pop corn varieties include Monarch Butterfly, Yellow Butterfly, Midnight Blue, Ruby Red, Mixed Baby Rice, Queen Mauve, Mushroom Flake, Japanese Hull-less, Strawberry, Blue Shaman, Miniature Colored, Miniature Pink, Pennsylvania Dutch Butter Flavor, and Red Strawberry.

Dent Corn

Dent corn varieties include Bloody Butcher, Blue Clarage, Ohio Blue Clarage, Cherokee White Eagle, Hickory Cane, Hickory King, Jellicorse Twin, Kentucky Rainbow, Daymon Morgan's Knt. Butcher, Learning, Learning's Yellow, McCormack's Blue Giant, Neal Paymaster, Pungo Creek Butcher, Reid's Yellow Dent, Rotten Clarage, and Tennessee Red Cob.

In some embodiments, corn varieties include P1618W, P1306W, P1345, P1151, P1197, P0574, P0589, and P0157. W=white corn.

In some embodiments, the methods and bacteria described herein are suitable for any hybrid of the maize varieties setforth herein.

Genetically Modified Maize

The methods and bacteria described herein are suitable for any of a hybrid, variety, lineage, etc. of genetically modified maize plants or part thereof.

Furthermore, the methods and bacteria described herein are suitable for any of the following genetically modified maize events, which have been approved in one or more countries: 32138 (32138 SPT Maintainer), 3272 (ENOGEN), 3272×Bt11, 3272×bt11×GA21, 3272×Bt11×MIR604, 3272×Bt11×MIR604×GA21, 3272×Bt11×MIR604×TC1507×5307×GA21, 3272×GA21, 3272×MIR604, 3272×MIR604×GA21, 4114, 5307 (AGRISURE Duracade), 5307×GA21, 5307×MIR604×Bt11×TC1507×GA21 (AGRISURE Duracade 5122), 5307×MIR604×Bt11×TC1507×GA21×MIR162 (AGRISURE Duracade 5222), 59122 (HERCULEX RW), 59122×DAS40278, 59122×GA21, 59122×MIR604, 59122×MIR604×GA21, 59122×MIR604×TC1507, 59122×MIR604×TC1507×GA21, 59122×MON810, 59122×MON810×M1R604, 59122×MON810×NK603, 59122×MON810×NK603×MIR604, 59122×MON88017, 59122×MON88017×DAS40278, 59122×NK603 (Herculex RW ROUNDUP READY 2), 59122×NK603×M1R604, 59122×TC1507×GA21, 676, 678, 680, 3751 IR, 98140, 98140×59122, 98140×TC1507, 98140×TC1507×59122, Bt10 (Bt10), Bt11 [X4334CBR, X4734CBR] (AGRISURE CB/LL), Bt11×5307, Bt11×5307×GA21, Bt11×59122×M1R604, Br11×59122×MIR604×GA21, Bt11×59122×MIR604×TC1507, M53, M56, DAS-59122-7, Bt11×59122×M1R604×TC1507×GA21, Bt11×59122×TC1507, TC1507×DAS-59122-7, Bt11×59122×TC1507×GA21, Bt11×GA21 (AGRISURE GT/CB/LL), Bt11×M1R162 (AGRISURE Viptera 2100), BT11×MIR162×5307, Bt11×M1R162×5307×GA21, Bt11×MIR162×GA21 (AGRISURE Viptera 3110), Bt11×MIR162×MIR604 (AGRISURE Viptera 3100), Bt11×MIR162×MIR604×5307, Bt11×MIR162×M1R604×5307×GA21, Bt11×MIR162×MIR604×GA21 (AGRISURE Viptera 3111/AGRISURE Viptera 4), Bt11, MIR162×M1R604×MON89034×5307×GA21, Bt11×MIR162×MIR604×TC1507, Bt11×MIR162×MIR604×TC1507×5307, Bt11×MIR162×MIR604×TC1507×GA21, Bt11×MIR162×MON89034, Bt11×MIR162×MON89034×GA21, Bt11×M1R162×TC1507, Bt11×MIR162×TC1507×5307, Bt11×MIR162×TC1507×5307×GA21, Bt11×MR162×TC1507×GA21 (AGRISURE Viptera 3220), BT11×M1R604 (Agrisure BOLL/RW), Bt11×MIR604×5307, Bt11×MIR604×5307×GA21, Bt11×M1R604×GA21, Bt11×MIR604×TC1507, Bt11×MIR604×TC1507×5307, Bt11×MIR604×TC1507×GA21, Bt11×MON89Ø34×GA21, Bt11×TC1507, Bt11×TC1507×5307, Bt11×TC1507×GA21, Bt176 [176] (NaturGard KnockOut/Maximizer), BVLA430101, CBH-351 (STARLINK Maize), DAS40278 (ENLIST Maize), DAS40278×NK603, DBT418 (Bt Xtra Maize), DLL25 [B16], GA21 (ROUNDUP READY Maize/AGRISURE GT), GA21×MON810 (ROUNDUP READY Yieldgard Maize), GA21×T25, HCEM485, LY038 (MAVERA Maize), LY038×MON810 (MAVERA Yieldgard Maize), MIR162 (AGRISURE Viptera), MIR162×5307, MIR162×5307×GA21, MIR162×GA21, MIR162×MIR604, MIR162×MIR604×5307, MIR162×MIR604×5307×GA21, MIR162×MIR604×GA21, MIR162×MIR604×TC1507×5307, MIR162×MIR604×TC1507×5307×GA21, MIR162×MIR604×TC1507×GA21. MIR162×MON89Ø34, MIR162×NK603, MIR162×TC1507, MIR162×TC1507×5307, MIR162×TC1507×5307×GA21, MIR162×TCI 507×GA21, MIR604 (AGRISURE RW), MIR604×5307, MIR604×5307×GA21, MIR604×GA21 (AGRISURE GT/RW), MIR604×NK603, MIR604×TC1507, MIR604×TC1507×5307, M1R604×TC1507×5307 xGA21, MIR604×TC1507×GA21, MON801 [MON80100], MON802, MON809, MON810 (YIELDGARD, MAIZEGARD), MON810×MIR162, MON810×MIR162×NK603, MON810×MIR604, MON810×MON88017 (YIELDGARD VT Triple), MON810×NK603×MIR604, MON832 (ROUNDUP READY Maize), MON863 (YIELDGARD Rootworm RW, MAXGARD), MON863×MON810 (YIELDGARD Plus), MON863×MON810×NK603 (YIELDGARD Plus with RR), MON863×NK603 (YIELDGARD RW+RR), MON87403, MON87411, MON87419, MON87427 (ROUNDUP READY Maize), MON87427×59122, MON87427×MON88017, MON87427×MON88017×59122, MON87427×MON89034, MON87427×MON89034×59122, MON87427×MON89034×MIR162×MON87411, MON87427×MON89034×MON88017, MON87427×MON89034×MON88017×59122, MON87427×MON89034×NK603, MON87427×MON89034×TCI 507, MON87427×MON89034×TC1507×59122, MON87427×MON89034×TC1507×MON87411×59122, MON87427×MON89034×TC 1507×MON87411×59122×DAS40278, MON87427×MON89034×TC 1507×MON88017, MON87427×MON89Ø34×MIR162×NK603, MON87427×MON89034×TC1507×MON88017×59122, MON87427×TC1507, MON87427×TC1507×59122, MON87427×TC1507×MON88017, MON87427×TC1507×MON88017×59122, MON87460 (GENUITY DROUGHTGARD), MON87460×MON88017, MON87460×MON89034×MON88017, MON87460×MON89034×NK603, MON87460×NK603, MON88017, MON88017×DAS40278, MON89034, MON89034×59122, MON89034×59122×DAS40278, MON89034×59122×MON88017, MON89034×59122×MON88017×DAS40278, MON89034×DAS40278, MON89034×MON87460, MON89034×MON88017 (GENUITY VT Triple Pro), MON89034×MON88017×DAS40278, MON89034×NK603 (GENUITY VT Double Pro), MON89034×NK603×DAS40278, MON89034×TC1507, MON89034×TC1507×59122, MON89034×TC1507×59122×DAS40278, MON89034×TC1507×DAS40278, MON89034×TC1507×MON88017, MON89034×TC1507×MON88017×59122 (GENUITY SMARTSTAX), MON89034×TC1507×MON88017×59122×DAS40278, MON89034×TC1507×MON88017×DAS40278, MON89034×TC1507×NK603 (POWER CORE), MON89034×TC1507×NK603×DAS40278, MON89034×TC1507×NK603×MIR162, MON89034×TC1507×NK603×MIR162×DAS40278, MON89Ø34×GA21, MS3 (INVIGOR Maize), MS6 (INVIGOR Maize), MZHG0JG, MZIR098, NK603 (ROUNDUP READY 2 Maize), NK603×MON810×4114×MIR604, NK603×MON810 (YIELDGARD CB+RR), NK603×T25 (ROUNDUP READY LIBERTY LINK Maize), T14 (LIBERTY LINK Maize), T25 (LIBERTY LINK Maize), T25×MON810 (LIBERTY LINK YIELDGARD Maize), TC1507 (HERCULEX I, HERCULEX CB), TC1507×59122×MON810×MIR604×NK603 (OPTIMUM INTRASECT XTREME), TC1507×MON810×MIR604×NK603, TC1507×5307, TC1507×5307×GA21, TC1507×59122 (HERCULEX XTRA), TC1507×59122×DAS40278, TC1507×59122×MON810, TC1507×59122×MON810×MIR604, TC1507×59122×MON810×NK603 (OPTIMUM INTRASECT XTRA), TC1507×59122×MON88017, TC1507×59122×MON88017×DAS40278, TC1507×59122×NK603 (HERCULEX XTRA RR), TC1507×59122×NK603×MIR604, TC1507×DAS40278, TC1507×GA21, TC1507×MIR162×NK603, TC1507×MIR604×NK603 (OPTIMUM TRISECT), TC1507×MON810, TC1507×MON810×M1R162, TC1507×MON810×M1R162×NK603, TCI507×MON810×MIR604, TC1507×MON810×NK603 (OPTIMUM INTRASECT), TC1507×MON810×NK603×MIR604, TCI507×MON88017, TCI507×MON88017×DAS40278, TC1507×NK603 (HERCULEX I RR), TC1507×NK603×DAS40278, TC6275, and VCO-01981-5.

Additional Genetically Modified Plants

The methods and bacteria described herein are suitable for any of a variety of genetically modified plants or part thereof.

Furthermore, the methods and bacteria described herein are suitable for any of the following genetically modified plant events which have been approved in one or more countries.

TABLE 14

Rice Traits, which can be combined with microbes of the disclosure
*Oryza saliva* Rice

| Event | Company | Description |
|---|---|---|
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| LMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience(AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 15

Alfalfa Traits, which can be combined with microbes of the disclosure
*Medicago sativa* Alfalfa

| Event | Company | Description |
|---|---|---|
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 16

Wheat Traits, which can be combined with microbes of the disclosure
*Triticum aestivum* Wheat

| Event | Company | Description |
|---|---|---|
| AP205CL | BASF Inc. | Selection for a mutagenized version of the enzyme acetohydroxyacid synthase (Al LAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |

TABLE 17

| Sunflower Traits, which can be combined with microbes of the disclosure *Helianthus annuus* Sunflower | | |
|---|---|---|
| Event | Company | Description |
| X81359 | BASF Inc. | Tolerance to imidazolinone herbicides by selection of a naturally occurring mutant. |

TABLE 18

| Soybean Traits, which can be combined with microbes of the disclosure *Glycine max* L. Soybean | | |
|---|---|---|
| Event | Company | Description |
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega 6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetlytransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (Gm Fad2-1) encoding gene from soybean, which resulted in “silencing” of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |
| GU262 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| MON87701 | Monsanto Company | Resistance to Lepidopteran pests of soybean including velvetbean caterpillar (*Anticarsia gemmatalis*) and soybean looper (*Pseudoplusia includens*). |

TABLE 18-continued

| Soybean Traits, which can be combined with microbes of the disclosure *Glycine max* L. Soybean | | |
|---|---|---|
| Event | Company | Description |
| MON87701 × MON89788 | Monsanto Company | Glyphosate herbicide tolerance through expression of the EPSPS encoding gene from *A. tumefaciens* strain CP4, and resistance to Lepidopteran pests of soybean including velvetbean caterpillar (*Anticarsia gemmatalis*) and soybean looper (*Pseudoplusia includens*) via expression of the Cry1Ac encoding gene from *B. thuringiensis*. |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces hygroscopicus*. |

TABLE 19

| Corn Traits, which can be combined with microbes of the disclosure *Zea mays* L. Maize | | |
|---|---|---|
| Event | Company | Description |
| 176 | Syngenta Seeds, Inc. | Insect-resistant maize produced by inserting the Cry1Ab gene from *Bacillus thuringiensis* subsp. *kurstaki*. The genetic modification affords resistance to attack by the European corn borer (ECB). |
| 3751 IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the Cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of |

TABLE 19-continued

| Corn Traits, which can be combined with microbes of the disclosure<br>*Zea mays* L. Maize | | |
|---|---|---|
| | | parental lines BT11 (OECD unique identifier: SYN-BTO11-1) and GA21 (OECD unique identifier: MON-OOO21-9). |
| BT11 × MIR162 × MIR604 × GA21 | Syngenta Seeds, Inc. | Resistance to Coleopteran pests, particularly corn rootworm pests (*Diabrotica* spp.) and several Lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) and MIR162 (OECD unique identifier: SYN-1R162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. |
| BT11 × MIR162 × MLR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYNBTO11-1) × *Bacillus thuringiensis* Vip3Aa20 insecticidal protein and the genetic material necessary for its production (via elements of vector pNOV1300) m Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-1R604-5). |
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW AgroSciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus*. |
| BT11 × MIR604 | Syngenta Seeds, Inc. | Stacked insect resistant and herbicide tolerant maize produced by conventional cross breeding of |

TABLE 19-continued

Corn Traits, which can be combined with microbes of the disclosure
*Zea mays* L. Maize

| | | |
|---|---|---|
| | | parental lines BT11 (OECD unique identifier: SYN-BTO11-1) and MIR604 (OECD unique identifier: SYN-1R6O5-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm -resistance is derived from MIR604 which contains the mCry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-1R6O5-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. Tolerance to glyphosate herbicide is derived from GA21 which contains a a modified EPSPS gene from maize. |
| DAS-59122-7 | DOW AgroSciences LLC and Pioneer Hi-Bred International Inc. | Corn rootworm-resistant maize produced by inserting the Cry34Ab1 and Cry35Ab1 genes from *Bacillus thuringiensis* strain PS149B1. The PAT encoding gene from *Streptomyces viridochromogenes* was introduced as a selectable marker. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-01507-1) with NK603 (OECD unique identifier: MON-00603-6). Corn rootworm-resistance is derived from DAS-59122- 7 which contains the Cry34Abl and Cry35Abl genes from *Bacillus thuringiensis* strain P5149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin |

TABLE 19-continued

Corn Traits, which can be combined with microbes of the disclosure
*Zea mays* L. Maize

| | | |
|---|---|---|
| | | acetyltransferase (PAT) from *Streptomyces hygroscopicus*. |
| MIR604 × GA21 | Syngenta Seeds, Inc. | Stacked insect resistant and herbicide tolerant maize produced by conventional cross breeding of parental lines MIR604 (OECD unique identifier: SYN-1R605-5) and GA21 (OECD unique identifier: MON-00021-9). Corn rootworm-resistance is derived from MIR604 which contains the mCry3A gene from *Bacillus thuringiensis*. Tolerance to glyphosate herbicide is derived from GA21. |
| MON80100 | Monsanto Company | Insect-resistant maize produced by inserting the Cry1Ab gene from *Bacillus thuringiensis* subsp. *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpynivyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic modification affords resistance to attack by the European corn borer (ECB). |
| MONS10 × LY038 | Monsanto Company | Stacked insect resistant and enhanced lysine content maize derived from conventional crossbreeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88017-3). European corn borer (ECB) resistance is derived from a truncated form of the Cry1Ab gene from *Bacillus thuringiensis* subsp. *kurstaki* HD-1 present in MON810. Corn rootworm resistance is derived from the Cry3Bbl gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5- |

TABLE 19-continued

| Corn Traits, which can be combined with microbes of the disclosure *Zea mays* L. Maize | | |
|---|---|---|
| | | enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bbl gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-00863-5) and MON810 (OECD identifier: MON-00810-6) |
| MON863 × MON810 × Monsanto NK603 | Monsanto Company | Stacked insect resistant and herbicide tolerant corn hybrid derived from conventional crossbreeding of the stacked hybrid MON-00863-5 × MON-00810-6 and NK603 (OECD identifier: MON-00603-6). |
| MON863 × NK603 | Monsanto Company | Stacked insect resistant and herbicide tolerant corn hybrid derived from conventional crossbreeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Crv3Bbl gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of Lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89034-3) with NK603 (OECD unique identifier: |

TABLE 19-continued

Corn Traits, which can be combined with microbes of the disclosure
*Zea mays* L. Maize

| | | |
|---|---|---|
| | | MON-00603-6). Resistance to Lepidopteran insects is derived from two Cry genes present in MON89043. Tolerance to glyphosate herbicide is derived from NK603. |
| NK603 × MON810 | Monsanto Company | Stacked insect resistant and herbicide tolerant corn hybrid derived from conventional crossbreeding of the parental lines NK603 (OECD identifier: MON-00603-6) and MON810 (OECD identifier: MON-00810-6). |
| MON89034 × TC1507 × MON88017 × DAS-59122-7 | Monsanto Company and My cogen Seeds c/o Dow AgroSciences LLC | Stacked insect resistant and herbicide tolerant maize produced by conventional cross breeding of parental lines: MON89034, TC1507, MON88017, and DAS-59 122. Resistance to the above-ground and below-ground insect pests and tolerance to glyphosate and glufosinate-ammonium containing herbicides. |
| M53 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| M56 | Bayer CropScience (Aventis CropScience(AgrEvo) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × T25 | Monsanto Company | Stacked glufosinate ammonium and glyphosate herbicide tolerant maize hybrid derived from conventional cross-breeding of the parental lines NK603 (OECD identifier: MON-00603-6) and T25 (OECD identifier: ACS-ZM003-2). |
| T25 × MONS10 | Bayer CropScience (Aventis CropScience(AgrEvo)) | Stacked insect resistant and herbicide tolerant corn hybrid derived from conventional crossbreeding of the parental lines T25 (OECD identifier: ACS-ZMOO3-2) and MON810 (OECD identifier: MON-OO81O-6). |
| TC1507 | Mycogen (c/o Dow AgroSciences); Pioneer (c/o DuPont) | Insect-resistant and glufosinate ammonium herbicide tolerant maize produced by inserting the Cry1F gene from *Bacillus thuringiensis* var. *aizawai* and the phosphinothricin N-acetyltransferase encoding gene from *Streptomyces viridochromogenes*. |
| TC1507 × NK603 | DOW AgroSciences LLC | Stacked insect resistant and herbicide tolerant corn hybrid derived from conventional crossbreeding of the parental lines 1507 (OECD identifier: DAS-O1507-1) and NK603 (OECD identifier: MON-OO6O3-6). |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O1507-1) with DAS-59122-7 (OECD unique |

TABLE 19-continued

| Corn Traits, which can be combined with microbes of the disclosure *Zea mays* L. Maize | | | |
|---|---|---|---|
| | | identifier: DAS-59122-7). Resistance to Lepidopteran insects is derived from TC1507 due the presence of the Cry1F gene from *Bacillus thuringiensis* var. *aizawai*. Corn rootworm-resistance is derived from DAS-59122-7 which contains the Cry34Ab1 and Crv35Ab1 genes from *Bacillus thuringiensis* strain P5149B1. Tolerance to glufosinate ammonium herbicide is derived from TC1507 from the phosphinothricin N-acetyltransferase encoding gene from *Streptomyces viridochromogenes*. | |
| Event | Company | Description | Hybrid Family |
| P0157 | Dupont Pioneer | | P0157 |
| P0157AM | Dupont Pioneer | AM LL RR2 | P0157 |
| P0157AMXT | Dupont Pioneer | AMXT LL RR2 | P0157 |
| P0157R | Dupont Pioneer | RR2 | P0157 |
| P0339AM | Dupont Pioneer | AM LL RR2 | P0339 |
| P0339AMXT | Dupont Pioneer | AMXT LL RR2 | P0339 |
| P0306AM | Dupont Pioneer | AM LL RR2 | P0306 |
| P0589 | Dupont Pioneer | | P0589 |
| P0589AM | Dupont Pioneer | AM LL RR2 | P0589 |
| P0589AMXT | Dupont Pioneer | AMXT LL RR2 | P0589 |
| P0589R | Dupont Pioneer | RR2 | P0589 |
| P0574 | Dupont Pioneer | | P0574 |
| P0574AM | Dupont Pioneer | AM LL RR2 | P0574 |
| P0574AMXT | Dupont Pioneer | AMXT LL RR2 | P0574 |
| PO533EXR | Dupont Pioneer | HXX LL RR2 | P0533 |
| P0506AM | Dupont Pioneer | AM LL RR2 | P0566 |
| P0760AMXT | Dupont Pioneer | AMXT LL RR2 | P0760 |
| P0707AM | Dupont Pioneer | AM LL RR2 | P0707 |
| P0707AMXT | Dupont Pioneer | AMXT LL RR2 | P0707 |
| P0825AM | Dupont Pioneer | AM LL RR2 | P0825 |
| P0825AMXT | Dupont Pioneer | AMXT LL RR2 | P0825 |
| P0969AM | Dupont Pioneer | AM LL RR2 | P0969 |
| P0969AMXT | Dupont Pioneer | AMXT LL RR2 | P0969 |
| P0937AM | Dupont Pioneer | AM LL RR2 | P0937 |
| P0919AM | Dupont Pioneer | AM LL RR2 | P0919 |
| P0905EXR | Dupont Pioneer | HXX LL RR2 | P0905 |
| P1197 | Dupont Pioneer | | P1197 |
| P1197AM | Dupont Pioneer | AM LL RR2 | P1197 |
| P1197AMXT | Dupont Pioneer | AMXT LL RR2 | P1197 |
| P1197R | Dupont Pioneer | RR2 | P1197 |
| P1151 | Dupont Pioneer | | P1151 |
| P1151AM | Dupont Pioneer | AM LL RR2 | P1151 |
| P1151R | Dupont Pioneer | RR2 | P1151 |
| P1138AM | Dupont Pioneer | AM LL RR2 | P1138 |
| P1366AM | Dupont Pioneer | AM LL RR2 | P1366 |
| P1366AMXT | Dupont Pioneer | AMXT LL RR2 | P1366 |
| P1365AMX | Dupont Pioneer | AMX LL RR2 | P1365 |
| P1353AM | Dupont Pioneer | AM LL RR2 | P1353 |
| P1345 | Dupont Pioneer | | P1345 |
| P1311AMXT | Dupont Pioneer | AMXT LL RR2 | P1311 |
| P1498EHR | Dupont Pioneer | HX1 LL RR2 | P1498 |
| P1498R | Dupont Pioneer | RR2 | P1498 |
| P1443AM | Dupont Pioneer | AM LL RR2 | P1443 |
| P1555CHR | Dupont Pioneer | RW HX1 LL RR2 | P1555 |
| P1751AMT | Dupont Pioneer | AMT LL RR2 | P1751 |
| P2089AM | Dupont Pioneer | AM LL RR2 | P2089 |
| QROME | Dupont Pioneer | Q LL RR2 | |

The following are the definitions for the shorthand occurring in Table 19. AM—OPTIMUM ACREMAX Insect Protection system with YGCB, HX1, LL, RR2. AMT—OPTIMUM ACREMAX TRISECT Insect Protection System with RW,YGCB,HX1,LL,RR2. AMXT—(OPTIMUM ACREMAX XTreme). HXX—HERCULEX XTRA contains the Herculex I and Herculex RW genes. HX1—Contains the HERCULEX I Insect Protection gene which provides protection against European corn borer, southwestern corn borer, black cutworm, fall armyworm, western bean cutworm, lesser corn stalk borer, southern corn stalk borer, and sugarcane borer; and suppresses corn earworm. LL—Contains the LIBERTYLINK gene for resistance to LIBERTY herbicide. RR2—Contains the ROUNDUP READY Corn 2 trait that provides crop safety for over-the-top applications of labeled glyphosate herbicides when applied according to label directions. YGCB—contains the YIELDGARD Corn Borer gene offers a high level of resistance to European corn borer, southwestern corn borer, and southern cornstalk borer; moderate resistance to corn earworm and common stalk borer; and above average resistance to fall armyworm. RW—contains the AGRISURE root worm resistance trait. Q—provides protection or suppression against susceptible European corn borer, southwestern corn borer, black cutworm, fall armyworm, lesser corn stalk borer, southern corn stalk borer, stalk borer, sugarcane borer, and corn earworm; and also provides protection from larval injury caused by susceptible western corn rootworm, northern corn rootworm, and Mexican corn rootworm; contains (1) HERCULEX XTRA Insect Protection genes that produce Cry 1F and Cry34abl and Cry35abl proteins, (2) AGRISURE RW trait that includes a gene that produces mCry3A protein, and (3) YIELDGARD Corn Borer gene which produces Cry1Ab protein.

compositions comprise about $1\times10^4$ to about $1\times10^8$ cfu per seed. In other particular aspects, the seed treatment compositions comprise about $1\times10^5$ to about $1\times10^7$ cfu per seed. In other aspects, the seed treatment compositions comprise about $1\times10^6$ cfu per seed.

In the United States, about 10% of corn acreage is planted at a seed density of above about 36,000 seeds per acre; ⅓ of the corn acreage is planted at a seed density of between about 33,000 to 36,000 seeds per acre; ⅓ of the corn acreage is planted at a seed density of between about 30,000 to 33,000 seeds per acre, and the remainder of the acreage is variable. See, "Corn Seeding Rate Considerations," written by Steve Butzen, available at: www.pioneer.com/home/site/us/agronomy-library/corn-seeding-rate-considerations/

Table 20 below utilizes various cfu concentrations per seed in a contemplated seed treatment embodiment (rows across) and various seed acreage planting densities ($1^{st}$ column: 15K-41K) to calculate the total amount of cfu per acre, which would be utilized in various agricultural scenarios (i.e. seed treatment concentration per seed×seed density planted per acre). Thus, if one were to utilize a seed treatment with $1\times10^6$ cfu per seed and plant 30,000 seeds per acre, then the total cfu content per acre would be $3\times10^{10}$ (i.e. 30K*$1\times10^6$)

TABLE 20

Total CFU Per Acre Calculation for Seed Treatment Embodiments

| Corn Population (i.e. seeds per acre) | 1.00E+02 | 1.00E+03 | 1.00E+04 | 1.00E+05 | 1.00E+06 | 1.00E+07 | 1.00E+08 | 1.00E+09 |
|---|---|---|---|---|---|---|---|---|
| 15,000 | 1.50E+06 | 1.50E+07 | 1.50E+08 | 1.50E+09 | 1.50E+10 | 1.50E+11 | 1.50E+12 | 1.50E+13 |
| 16,000 | 1.60E+06 | 1.60E+07 | 1.60E+08 | 1.60E+09 | 1.60E+10 | 1.60E+11 | 1.60E+12 | 1.60E+13 |
| 17,000 | 1.70E+06 | 1.70E+07 | 1.70E+08 | 1.70E+09 | 1.70E+10 | 1.70E+11 | 1.70E+12 | 1.70E+13 |
| 18,000 | 1.80E+06 | 1.80E+07 | 1.80E+08 | 1.80E+09 | 1.80E+10 | 1.80E+11 | 1.80E+12 | 1.80E+13 |
| 19,000 | 1.90E+06 | 1.90E+07 | 1.90E+08 | 1.90E+09 | 1.90E+10 | 1.90E+11 | 1.90E+12 | 1.90E+13 |
| 20,000 | 2.00E+06 | 2.00E+07 | 2.00E+08 | 2.00E+09 | 2.00E+10 | 2.00E+11 | 2.00E+12 | 2.00E+13 |
| 21,000 | 2.10E+06 | 2.10E+07 | 2.10E+08 | 2.10E+09 | 2.10E+10 | 2.10E+11 | 2.10E+12 | 2.10E+13 |
| 22,000 | 2.20E+06 | 2.20E+07 | 2.20E+08 | 2.20E+09 | 2.20E+10 | 2.20E+11 | 2.20E+12 | 2.20E+13 |
| 23,000 | 2.30E+06 | 2.30E+07 | 2.30E+08 | 2.30E+09 | 2.30E+10 | 2.30E+11 | 2.30E+12 | 2.30E+13 |
| 24,000 | 2.40E+06 | 2.40E+07 | 2.40E+08 | 2.40E+09 | 2.40E+10 | 2.40E+11 | 2.40E+12 | 2.40E+13 |
| 25,000 | 2.50E+06 | 2.50E+07 | 2.50E+08 | 2.50E+09 | 2.50E+10 | 2.50E+11 | 2.50E+12 | 2.50E+13 |
| 26,000 | 2.60E+06 | 2.60E+07 | 2.60E+08 | 2.60E+09 | 2.60E+10 | 2.60E+11 | 2.60E+12 | 2.60E+13 |
| 27,000 | 2.70E+06 | 2.70E+07 | 2.70E+08 | 2.70E+09 | 2.70E+10 | 2.70E+11 | 2.70E+12 | 2.70E+13 |
| 28,000 | 2.80E+06 | 2.80E+07 | 2.80E+08 | 2.80E+09 | 2.80E+10 | 2.80E+11 | 2.80E+12 | 2.80E+13 |
| 29,000 | 2.90E+06 | 2.90E+07 | 2.90E+08 | 2.90E+09 | 2.90E+10 | 2.90E+11 | 2.90E+12 | 2.90E+13 |
| 30,000 | 3.00E+06 | 3.00E+07 | 3.00E+08 | 3.00E+09 | 3.00E+10 | 3.00E+11 | 3.00E+12 | 3.00E+13 |
| 31,000 | 3.10E+06 | 3.10E+07 | 3.10E+08 | 3.10E+09 | 3.10E+10 | 3.10E+11 | 3.10E+12 | 3.10E+13 |
| 32,000 | 3.20E+06 | 3.20E+07 | 3.20E+08 | 3.20E+09 | 3.20E+10 | 3.20E+11 | 3.20E+12 | 3.20E+13 |
| 33,000 | 3.30E+06 | 3.30E+07 | 3.30E+08 | 3.30E+09 | 3.30E+10 | 3.30E+11 | 3.30E+12 | 3.30E+13 |
| 34,000 | 3.40E+06 | 3.40E+07 | 3.40E+08 | 3.40E+09 | 3.40E+10 | 3.40E+11 | 3.40E+12 | 3.40E+13 |
| 35,000 | 3.50E+06 | 3.50E+07 | 3.50E+08 | 3.50E+09 | 3.50E+10 | 3.50E+11 | 3.50E+12 | 3.50E+13 |
| 36,000 | 3.60E+06 | 3.60E+07 | 3.60E+08 | 3.60E+09 | 3.60E+10 | 3.60E+11 | 3.60E+12 | 3.60E+13 |
| 37,000 | 3.70E+06 | 3.70E+07 | 3.70E+08 | 3.70E+09 | 3.70E+10 | 3.70E+11 | 3.70E+12 | 3.70E+13 |
| 38,000 | 3.80E+06 | 3.80E+07 | 3.80E+08 | 3.80E+09 | 3.80E+10 | 3.80E+11 | 3.80E+12 | 3.80E+13 |
| 39,000 | 3.90E+06 | 3.90E+07 | 3.90E+08 | 3.90E+09 | 3.90E+10 | 3.90E+11 | 3.90E+12 | 3.90E+13 |
| 40,000 | 4.00E+06 | 4.00E+07 | 4.00E+08 | 4.00E+09 | 4.00E+10 | 4.00E+11 | 4.00E+12 | 4.00E+13 |
| 41,000 | 4.10E+06 | 4.10E+07 | 4.10E+08 | 4.10E+09 | 4.10E+10 | 4.10E+11 | 4.10E+12 | 4.10E+13 |

Concentrations and Rates of Application of Agricultural Compositions

As aforementioned, the agricultural compositions of the present disclosure, which comprise a taught microbe, can be applied to plants in a multitude of ways. In two particular aspects, the disclosure contemplates an in-furrow treatment or a seed treatment For seed treatment embodiments, the microbes of the disclosure can be present on the seed in a variety of concentrations. For example, the microbes can be found in a seed treatment at a cfu concentration, per seed of: $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, or more. In particular aspects, the seed treatment For in-furrow embodiments, the microbes of the disclosure can be applied at a cfu concentration per acre of: $1\times10^6$, $3.20\times10^{10}$, $1.60\times10^{11}$, $3.20\times10^{11}$, $8.0\times10^{11}$, $1.6\times10^{12}$, $3.20\times10^{12}$, or more. Therefore, in aspects, the liquid in-furrow compositions can be applied at a concentration of between about $1\times10^6$ to about $3\times10^{12}$ cfu per acre.

In some aspects, the in-furrow compositions are contained in a liquid formulation. In the liquid in-furrow embodiments, the microbes can be present at a cfu concentration per milliliter of: $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}2$, $1\times10^{13}$, or more. In certain aspects, the liquid in-furrow compositions comprise microbes at a concentration of about $1\times10^6$ to about $1\times10^{11}$ cfu per milliliter. In other aspects, the liquid in-furrow compositions comprise microbes at a concentration of about 1×$10^7$ to about 1×$10^{10}$ cfu per milliliter. In other aspects, the liquid in-furrow compositions comprise microbes at a concentration of about 1×$10^8$ to about 1×$10^9$ cfu per milliliter. In other aspects, the liquid in-furrow compositions comprise microbes at a concentration of up to about 1×$10^{13}$ cfu per milliliter.

Transcriptomic Profiling of Candidate Microbes

Previous work by the inventors entailed transcriptomic profiling of strain CI010 to identify promoters that are active in the presence of environmental nitrogen. Strain CI010 was cultured in a defined, nitrogen-free media supplemented with 10 mM glutamine. Total RNA was extracted from these cultures (QIAGEN RNeasy kit) and subjected to RNAseq sequencing via Illumina HiSeq (SeqMatic, Fremont Calif.). Sequencing reads were mapped to the CIO 0 genome data using Geneious, and highly expressed genes under control of proximal transcriptional promoters were identified.

Tables 21-23 lists genes and their relative expression level as measured through RNASeq sequencing of total RNA. Sequences of the proximal promoters were recorded for use in mutagenesis of nif pathways, nitrogen utilization related pathways, or other genes with a desired expression level.

TABLE 21

| Name | Minimum | Maximum | Length | Direction |
|---|---|---|---|---|
| murein lipoprotein CDS | 2,929,898 | 2,930,134 | 237 | forward |
| membrane protein CDS | 5,217,517 | 5,217,843 | 327 | forward |
| zinc/cadmium-binding protein CDS | 3,479,979 | 3,480,626 | 648 | forward |
| acyl carrier protein CDS | 4,563,344 | 4,563,580 | 237 | reverse |
| ompX CDS | 4,251,002 | 4,251,514 | 513 | forward |
| DNA-binding protein HU-beta CDS | 375,156 | 375,428 | 273 | forward |
| sspA CDS | 629,998 | 630,636 | 639 | reverse |
| tatE CDS | 3,199,435 | 3,199,638 | 204 | reverse |
| LexA repressor CDS | 1,850,457 | 1,851,065 | 609 | forward |
| hisS CDS | <3999979 | 4,001,223 | >1245 | forward |

TABLE 22

| Name | Differential Expression Absolute Confidence | Differential Expression Ratio | RNASeq_nifL - Raw Read Count | RNASeq_nifL - Raw Transcript Count | RNASeq_WT - Raw Read Count | RNASeq_WT - Raw Transcript Count |
|---|---|---|---|---|---|---|
| murein lipoprotein CDS | 1000 | −1.8 | 12950.5 | 10078.9 | 5151.5 | 4106.8 |
| membrane protein CDS | 1000 | −1.3 | 9522.5 | 5371.3 | 5400 | 3120 |
| zinc/cadmium-binding protein CDS | 3.3 | 1.1 | 6461 | 1839.1 | 5318 | 1550.6 |
| acyl carrier protein CDS | 25.6 | 1.6 | 1230.5 | 957.6 | 1473.5 | 1174.7 |
| ompX CDS | 1.7 | 1.1 | 2042 | 734.2 | 1687.5 | 621.5 |
| DNA-binding protein HU-beta CDS | 6.9 | −1.3 | 1305 | 881.7 | 725 | 501.8 |
| sspA CDS | 0.2 | 1 | 654 | 188.8 | 504.5 | 149.2 |
| tatE CDS | 1.4 | 1.3 | 131 | 118.4 | 125 | 115.8 |
| LexA repressor CDS | 0.1 | −1.1 | 248 | 75.1 | 164 | 50.9 |
| hisS CDS | 0 | −1.1 | 467 | 69.2 | 325 | 49.3 |

TABLE 23

| Name | Prm (In Forward direction, −250 to +10 region) SEQ ID NO: | Expressed Sequence SEQ ID NO: | Neighbor Sequence SEQ ID NO: |
|---|---|---|---|
| murein lipoprotein CDS | SEQ ID NO: 3 | SEQ ID NO: 13 | SEQ ID NO: 23 |
| membrane protein CDS | SEQ ID NO: 4 | SEQ ID NO: 14 | SEQ ID NO: 24 |
| zinc/cadmium-binding protein CDS | SEQ ID NO: 5 | SEQ ID NO: 15 | SEQ ID NO: 25 |
| acyl carrier protein CDS | SEQ ID NO: 6 | SEQ ID NO: 16 | SEQ ID NO: 26 |
| ompX CDS | SEQ ID NO: 7 | SEQ ID NO: 17 | SEQ ID NO: 27 |
| DNA-binding protein HU-beta CDS | SEQ ID NO: 8 | SEQ ID NO: 18 | SEQ ID NO: 28 |
| sspA CDS | SEQ ID NO: 9 | SEQ ID NO: 19 | SEQ ID NO: 29 |
| tatE CDS | SEQ ID NO: 10 | SEQ ID NO: 20 | SEQ ID NO: 30 |
| LexA repressor CDS | SEQ ID NO: 11 | SEQ ID NO: 21 | SEQ ID NO: 31 |
| hisS CDS | SEQ ID NO: 12 | SEQ ID NO: 22 | SEQ ID NO: 32 |

TABLE 24

Table of Strains

| Name | Lineage | Mutagenic DNA Description | Genotype | Gene 1 mutation | Gene 2 mutation |
|---|---|---|---|---|---|
| CI006 | Isolated strain from *Enterobacter* (now *Kosakonid*) genera | None | WT | | |
| CI008 | Isolated strain from *Burkholderia* genera | None | WT | | |
| CI010 | Isolated strain from *Klebsiella* genera | None | WT | | |
| CI019 | Isolated straw from *Rahnella* genera | None | WT | | |
| CI028 | Isolated strain from *Enterobacter* genera | None | WT | | |
| CI050 | Isolated strain from *Klebsiella* genera | None | WT | | |
| CM002 | Mutant of CI050 | Disruption of nifL gene with a kanamycin resistance expression cassette (KanR) encoding the aminoglycoside O-phosphotransferase gene aph1 inserted. | ΔnifL::KanR | SEQ ID NO: 33 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 34 | |
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 35 | |
| CM004 | Mutant of CI010 | Disruption of amtB gene with a kanamycin resistance expression cassette (KanR) encoding the aminoglycoside O-phosphotransferase gene aph1 inserted. | ΔamtB::KanR | SEQ ID NO: 36 | |
| CM005 | Mutant of CI010 | Disruption of nifL gene with a kanamycin resistance expression cassette (KanR) encoding the aminoglycoside O-phosphotransferase gene aph1 inserted. | ΔnifL::KanR | SEQ ID NO: 37 | |
| CM015 | Mutant of CI006 | Disruption of nifL gene with a fragment of the region upstream of the ompX gene inserted (Prm5). | ΔnifL::Prm5 | SEQ ID NO: 38 | |
| CM021 | Mutant of CI006 | Disruption of nifL gene with a fragment of the region upstream of an unanotated gene and the first 73 bp of that gene inserted (Prm2). | ΔnifL::Prm2 | SEQ ID NO: 39 | |
| CM023 | Mutant of CI006 | Disruption of nifL gene with a fragment of the region upstream of the acpP gene and the first 121 bp of the acpP gene inserted (Prm4). | ΔnifL::Prm4 | SEQ ID NO: 40 | |
| CM014 | Mutant of CI006 | Disruption of nifL gene with a fragment of the region upstream of the lpp gene and the first 19 bp of the lpp gene inserted (Prm1). | ΔnifL::Prm1 | SEQ ID NO: 41 | |
| CM016 | Mutant of CI006 | Disruption of nifL gene with a fragment of the region upstream of the lexA | ΔnifL::Prm9 | SEQ ID NO: 42 | |

TABLE 24-continued

| Table of Strains | | | | | |
|---|---|---|---|---|---|
| Name | Lineage | Mutagenic DNA Description | Genotype | Gene 1 mutation | Gene 2 mutation |
| | | 3 gene and the first 21 bp of the lexA 3 gene inserted (Prm9). | | | |
| CM022 | Mutant of CI006 | Disruption of nifL gene with a fragment of the region upstream of the mntP 1 gene and the first 53 bp of the mntP 1 gene inserted (Prm3). | ΔnifL::Prm3 | SEQ ID NO: 43 | |
| CM024 | Mutant of CI006 | Disruption of nifL gene with a fragment of the region upstream of the sspA gene inserted (Prm7). | ΔnifL::Prm7 | SEQ ID NO: 44 | |
| CM025 | Mutant of CI006 | Disruption of nifL gene with a fragment of the region upstream of the hisS gene and the first 52 bp of the hisS gene inserted (Prm10). | ΔnifL::Prm10 | SEQ ID NO: 45 | |
| CM006 | Mutant of CI010 | Disruption of glnB gene with a kanamycin resistance expression cassette (KanR) encoding the aminoglycoside O-phosphotransferase gene aph1 inserted. | ΔglnB::KanR | SEQ ID NO: 46 | |
| CM017 | Mutant of CI028 | Disruption of nifL gene with a kanamycin resistance expression cassette (KanR) encoding the aminoglycoside O-phosphotransferase gene aph1 inserted. | ΔnifL::KanR | SEQ ID NO: 47 | |
| CM011 | Mutant of CI019 | Disruption of nifL gene with a spectinomycin resistance expression cassette (SpecR) encoding the streptomycin 3"-O-adenylyltransferase gene aadA inserted. | ΔnifL::SpecR | SEQ ID NO: 48 | |
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 49 | |
| CM005 | Mutant of CI010 | Disruption of nifL gene with a kanamycin resistance expression cassette (KanR) encoding the aminoglycoside O-phosphotransferase gene aph1 inserted. | ΔnifL::KanR | SEQ ID NO: 50 | |
| CM014 | Mutant of CI006 | Disruption of niff. gene with a fragment of the region upstream of the lpp gene and the first 19 bp of the lpp gene inserted (Prm1). | ΔnifL::Prm1 | SEQ ID NO: 51 | |
| CM015 | Mutant of CI006 | Disruption of nifL gene with a fragment of the region upstream of the ompX gene inserted (Prm5). | ΔnifL::Prm5 | SEQ ID NO: 52 | |
| CM023 | Mutant of CI006 | Disruption of nifL gene with a fragment of the region upstream of the acpP gene and the first 121 bp of the acpP gene inserted (Prm4). | ΔnifL::Prm4 | SEQ ID NO: 53 | |
| CM029 | Mutant of CI006 | Disruption of nifL gene with a fragment of the region upstream of the ompX gene inserted (Prm5) and deletion of the 1287 bp | ΔnifL::Prm5 ΔglnE-AR_KO1 | SEQ ID NO: 54 | SEQ ID NO: 61 |

TABLE 24-continued

Table of Strains

| Name | Lineage | Mutagenic DNA Description | Genotype | Gene 1 mutation | Gene 2 mutation |
|---|---|---|---|---|---|
| | | after the start codon of the glnE gene containing the adenylyl-removing domain of glutamate-ammonia-ligase adenylyltransferase (ΔglnE-AR_KO1). | | | |
| CM014 | Mutant of CI006 | Disruption of nifL gene with a fragment of the region upstream of the lpp gene and the first 29 bp of the lpp gene inserted (Prm1). | ΔnifL::Prm1 | SEQ ID NO: 55 | |
| CM011 | Mutant of CI019 | Disruption of nifL gene with a spectinomycin resistance expression cassette (SpecR) encoding the streptomycin 3''-O-adenylyltransferase gene aadA inserted. | ΔnifL::SpecR | SEQ ID NO: 56 | |
| CM011 | Mutant of CI019 | Disruption of nifL gene with a spectinomycin resistance expression cassette (SpecR) encoding the streptomycin 3''-O-adenylyltransferase gene aadA inserted. | ΔnifL::SpecR | SEQ ID NO: 57 | |
| CM013 | Mutant of CI006 | Disruption of nifL gene with a kanamycin resistance expression cassette (KanR) encoding the aminoglycoside O-phosphotransferase gene aph1 inserted. | ΔnifL::KanR | SEQ ID NO: 58 | |
| CM011 | Mutant of CI019 | Disruption of nifL gene with a spectinomycin resistance expression cassette (SpecR) encoding the streptomycin 3''-O-adenylyltransferase gene aadA inserted. | ΔnifL::SpecR | SEQ ID NO: 59 | |
| CM011 | Mutant of CI019 | Disruption of nifL gene with a spectinomycin resistance expression cassette (SpecR) encoding the streptomycin 3''-O-adenylyltransferase gene aadA inserted. | ΔnifL::SpecR | SEQ ID NO: 60 | |

Biofilms

Most microorganisms live and grow in aggregated forms such as biofilms, flocs (planktonic biofilms), and sludges. See Costerton et al. 1995. *Annu. Rev. Microbial.* 49:711-745; Wimpenny. 2000. *In Community Structure and Co-operation in Biofilms* (ed. Allison, Gilbert, Lappin-Scott, and Wilson). Pp. 1-24, Cambridge University Press, Cambridge, UK. Biofilms are accumulations of multivalent cations, inorganic particles, and biogenic material, as well as colloidal and dissolved compounds. These forms of growth are frequently collectively referred to as biofilms. Biofilms are ubiquitously distributed in aquatic environments, on tissues of plants and animals, and on surfaces of filters, ship hulls, medical devices, etc. Biofilms typically develop at phase boundaries, and can frequently be found adherent to a solid surface at solid-water interfaces. Biofilms can also be found at solid-air interfaces.

Biofilm formation often begins when free-floating microorganisms such as bacteria come into contact with an appropriate surface and begin to secrete an extracellular polymeric substance (EPS). An EPS is a network of sugars, proteins, and nucleic acids which enables the microorganisms in a biofilm to adhere to one another. Contact and attachment to the appropriate surface is followed by a period of growth. Further layers of microorganism and EPS build upon the first layers. Nutrient channels crisscross biofilms allowing for the exchange of nutrients and waste products.

Biofilm formation is often determined by one or more environmental conditions that set forth whether the biofilm is only a few layers of cells or significantly more. For example, microorganisms that produce large amounts of EPS can grow into fairly thick biofilms even if they do not have access to a lot of nutrients. Microorganisms that depend on oxygen may be limited by how dense the biofilm can become. Cells within the biofilm can leave the biofilm and establish on a new surface. A clump of cells may break away or individual cells are released from the biofilm in a process known as seeding dispersal.

Communities of microbes are often more resilient to stressors such as lack of water, high or low pH, or the presence of toxic substances such as antibiotics, antimicrobials, or heavy metals. The hardiness of biofilms is believed to arise out of the EPS acting as a protective battier that prevents dehydration or acts as a shield against UV light. Harmful substances such as antimicrobials, bleach, or heavy metals are either bound or neutralized when they come into contact with the EPS. These substances may become diluted to sub-lethal concentrations prior to reaching various layers of cells within the biofilm. It is possible for certain antibiotics/antimicrobials to penetrate the EPS and proceed through the layers of the biofilm.

The microorganisms found within biofilms exist in close association at high cell densities, and are embedding in a matrix of EPS. EPS production is a general microbial property that is expressed in most environments. The ability to form EPS is widespread among prokaryotic organisms, but also can occur in eukaryotic microorganisms such as algaes, yeasts, molds, and fungi. See Ghosle. 2001. *Biofouling*. 17:117-127; and US20060096918A1. EPS are not essential structures of bacteria, but under natural conditions, EPS production is an important feature of survival given that most environmental bacteria occur in aggregates such as flocs and biofilms whose structural and functional integrity are based essentially on the presence of an EPS matrix.

The EPS are considered key components that determine the morphology, architecture, coherence, physiochemical properties, and biochemical activity of microbial aggregates. EPS form a three-dimensional, gel-like highly hydrated, and locally charged biofilm matrix in which the microorganisms essentially are immobilized. In general, the proportion of EPS in biofilms can vary between about 50% and about 90% of the total organic matter. See Nielsen et aL. 1997. *Wat. Sci. Tech.* 36:11-19. EPS are involved in the formation of activated sludge flocs (bioflocculation) and the development of fixed biofilms.

EPS can include substances such as, for example, polysaccharides (e.g., monosaccharides, uronic acids, and amino sugars linked by glycosidic bonds), polypeptides, nucleic acids, lipids/phospholipids (e.g., fatty acids, glycerol phosphate, ethanolamine, serine, and choline), and humic substances (e.g., phenolic compounds, simple sugars, and amino acids). The EPS compositions can be evaluated after removing the macromolecules from the microbial cells. Physical and chemical methods, including centrifugation, filtration, heating, blending, sonication, and treatment with sodium hydroxide, or complexing agents, and ion-exchange resins can be used to extract EPS from microbial aggregates. See Jahn and Nielsen. 1995. *Wat. Sci. Tech.* 31:157 164; and Nielsen and Jahn. 1999. *Microbial Extracel ular Polymeric substances* (ed. Wingender, neu, and Flemming), pp. 49-72, Springer, Berlin. The use of cation-exchange resin combined with stirring, for example, can be used to isolate EPS from a biofilm without causing significant cell lysis. Such methods are based on the removal of calcium ions, destabilizing the EPS structure, and facilitating the separation of the EPS from cells.

Biofilm-Producing Microorganisms

In some aspects, biofilm-producing microbes may be selected from microbes obtained from soil (e.g., rhizosphere), air, water (e.g., marine, freshwater, wastewater sludge), sediment, oil, plants (e.g., roots, leaves, stems), animals (e.g., mammals, reptiles, birds, and the like), agricultural products, and extreme environments (e.g., acid mine drainage or hydrothermal systems). In a further aspect, microbes obtained from marine or freshwater environments such as an ocean, river, or lake. In a further embodiment, the microbes can be from the surface of the body of water, or any depth of the body of water (e.g., a deep sea sample).

In aspects of the disclosure where the microbes are isolated from a source material (for example, the material in which they naturally reside), any one or a combination of a number of standard techniques which will be readily known to skilled persons may be used. However, by way of example, these in general employ processes by which a solid or liquid culture of a single microorganism can be obtained in a substantially pure form, usually by physical separation on the surface of a solid microbial growth medium or by volumetric dilutive isolation into a liquid microbial growth medium. These processes may include isolation from dry material, liquid suspension, slurries or homogenates in which the material is spread in a thin layer over an appropriate solid gel growth medium, or serial dilutions of the material made into a sterile medium and inoculated into liquid or solid culture media.

Biofilms can be formed from numerous types of microorganisms. For example, a biofilm can contain bacteria from the α-, β-, or γ-subclasses of Proteobacteria; gram-positive bacteria with a high GC content, and/or bacteria from the Cytophaga-*Flavobacterium* group. Various species of fungi and yeast are also known to produce biofilms.

In additional to bacteria, biofilms can contain or be produced by protozoan and metazoan organisms such as invertebrates (e.g., nematodes), *flagellates*, and ciliates (e.g., rotifers).

In some aspects, biofilm-producing microbes include bacteria, fungi, and yeasts. In some aspects, the biofilm-producing microbe is a bacterium. In some aspects, the biofilm-producing microbe is a fungus. In some aspects, the biofilm-producing microbe is a yeast. In some aspects, the biofilm-producing microbe is a flagellate. In some aspects, the biofilm-producing microbe is a ciliate. In some aspects, the biofilm-producing microbe is an algae.

In some aspects, the biofilm-producing microbe is a Gram negative bacterium. In some aspects, the biofilm-producing microbe is a Gram positive bacterium.

In some aspects, the biofilm-producing microbe is a pathogen. In some aspects, the biofilm-producing microbe is an obligate pathogen. In some aspects, the biofilm-producing microbe is an opportunistic pathogen. In some aspects, the biofilm-producing microbe is a plant pathogen. In some aspects, the biofilm-producing microbe is a human pathogen. In some aspects, the biofilm-producing microbe is an animal pathogen. In some aspects, the biofilm-producing microbe is a soil microbe. In some aspects, the biofilm-producing microbe is a plant colonizing microbe. In some aspects, the biofilm-producing microbe is a root colonizing microbe. In some aspects, the biofilm-producing microbe is a rhizosphere colonizing microbe.

In some aspects, the biofilm-producing microbe is selected from any one or more of the following species: *Pseudomonas fluorescens, Pseudomonas stutzeri, Pseudomonas putida, Pseudomonas aeruginosa, Rhizobium leguminosarum, Agrobacterium tumefaciens, Paenibacillus polymyxa, Bacillus subtilis, Bacillus cereus, Azospirillum braslinense, Acetobacter xylinum, Kosakonia sacchari, Staphylococcus aureus, Staphylococcus epidermidis, Staphylococcus cohnii, Enterococcus faecais, Listeria monocytogenes, Listeria ivanovii, Lysteria innocua, Micrococcus luteus, Rhodococcus fascians, Microbacterium oxydans, Williamsia muralis, Escherichia coli, Serratia marcescens, Comamonas acidovorans, Burkholderia cepacia, Citrobacter freundii, Legionella pneumophila, Legionella waltersii, Legionella brunensis, Salmonella enterica, Shewanella putrefaciens, Rhodotorula mucilaginosa*, and *Candida albicans.*

In some aspects, the biofilm-producing microbe is a species of any one or more of the following genera: *Pseudomonas, Rhizobium, Agrobacterium, Paenibacillus, Bacillus, Azospirillum, Erwinia, Xanthomonas, Pantoea, Acetobacter, Kosakonia, Staphylococcus, Mycobacterium, Micrococcus, Rhodococcus, Cellulosimicrobium, Microbacterium, Williamsia, Escherichia, Klebsiella, Streptococcus, Enterococcus, Leptospira, Clostridium, Listeria, Legionella, Salmonella, Campylobacter, Citrobacter, Shewanella, Burkholderia, Serratia, Comamonas, Cryptococcus, Candida, Saccharomyces, Penicillium, Cladosporium*, and *Rhodotorula*. In some aspects, the biofilm-producing microbe is a species of *Pseudomonas*. In some aspects, the biofilm-producing microbe is a species of Kosakonia.

Biofilm Production

In some aspects, the growth medium is inoculated with planktonic microbes. In some aspects, the growth medium is inoculated with sessile microbes already in a biofilm. In some aspects, the growth medium is inoculated with microbes in log phase growth. In some aspects, the growth medium is inoculated with microbes in lag phase growth. In some aspects, the growth medium is inoculated with microbes in stationary phase.

In some aspects, the biofilm-producing microbe produces a biofilm when growing at log phase. In some aspects, the biofilm-producing microbe produces a biofilm when growing at log phase.

In some aspects, biofilms are cultivated in a flask while shaking. In some aspects, biofilms are cultivated in a flask without shaking. In some aspects, biofilms are cultivated on a solid surface (carrier). In some aspects, biofilms are cultivated in a bioreactor. In some aspects, biofilms are cultivated in a chemostat. In some aspects, biofilms are cultivated in a continuous-flow system.

In some aspects, the biofilms are cultured by co-inoculating at least one strain in a growth medium. In some aspects, the biofilms are cultured by co-inoculating at least two strains in a growth medium. In some aspects, the biofilms are cultured by co-inoculating at least three strains in a growth medium. In some aspects, the biofilms are cultured by co-inoculating at least four strains in a growth medium. In some aspects, the biofilms are cultured by co-inoculating at least five strains in a growth medium.

In some aspects, biofilms are produced in bioreactors as described in EP2186890A1, WO2017203440A1, U.S. Pat. No. 5,116,506, US20090258404A1, and US20090152195A1.

In some aspects, the biofilms are cultivated in situ with one or more of the bacteria of the present disclosure. In some aspects, the growth media is capable of supporting log growth of one or more biofilm-producing microbes and one or more non-biofilm producing microbes. The co-cultivation of the one or more biofilm-producing microbes and the one or more non-biofilm producing microbes results in adequate log growth of the two or more microbes such that the non-biofilm-producing microbes are encased in the biofilm produced by the biofilm-producing microbes.

(i) Isolating/Collecting Biofilm

In some aspects, the biofilms are agitated in the growth medium to release the biofilm from the surface in which they are adhered. In some aspects, agitation includes scraping, sonication, sheer forces, shaking, etc.

In some aspects, the biofilms are isolated from the growth media or growth chambers and poured over a filter that will allow supernatant and planktonic single-celled microbes to pass through, while holding back the biofilm composition. In some aspects, the biofilms are isolated from the spent media by pouring the entire contents of the reaction chamber/growth flask into a filter comprising 5 micrometer diameter pores. In some aspects, the biofilms are isolated from the spent media by pouring the entire contents of the reaction chamber/growth flask into a filter comprising 10 micrometer diameter pores. In some aspects, the biofilms are isolated from the spent media by pouring the entire contents of the reaction chamber/growth flask into a filter comprising 15 micrometer diameter pores. In some aspects, the biofilms are isolated from the spent media by pouring the entire contents of the reaction chamber/growth flask into a filter comprising 20 micrometer diameter pores.

In some aspects, the filtration occurs with the assistance of a vacuum aspirator.

In some aspects, the biofilm material remaining in the filter is washed at least one time with an appropriate buffer or media. In some aspects, the biofilm material remaining in the filter is washed at least two times with an appropriate buffer or media. In some aspects, the biofilm material remaining in the filter is washed at least three times with an appropriate buffer or media.

In some aspects, the biofilm material remaining in the filter is washed at least four times with an appropriate buffer or media. In some aspects, the biofilm material remaining in the filter is washed at least five times with an appropriate buffer or media.

In some aspects, the biofilms are sonicated to allow the biofilm to break into slightly smaller sections and to prevent the recovered and purified biofilm from remaining in a single mass.

In some aspects, the biofilms are resuspended in a buffer or medium and concentrated into a smaller volume through the use of centrifugation or ultracentrifugation.

In some aspects, the biofilms are resuspended in a volume at 1×, 1.5×, 2×, 2.5×, 3×, 3.5×, 4×, 4.5×, 5×, 5.5×, 6×, 6.5×, 7×, 7.5×, 8×, 8.5×, 9×, 9.5×, or 10×.

(ii) Treating Biofilm

In some aspects, the biofilms are sterilized to kill the remaining microbes that produced the biofilms. In some aspects, the sterilization is heat killing. In some aspects, heat killing is autoclaving the biofilm. In some aspects, the sterilization exposure of the biofilms to UV rays. In some aspects, the sterilization exposure of the biofilms to X-rays. In some aspects, the sterilization exposure of the biofilms to gamma rays.

In some aspects, the biofilm sterilization does not modulate any one or more properties or traits conferred by the biofilm.

Biofilm Compositions

In some aspects, the biofilm composition is a combination of biofilm with any one or more microbes of the present disclosure. In some aspects, the biofilms are mixed with any one or more bacteria of the present disclosure. In some aspects, the biofilms are mixed with any one or more atmospheric nitrogen fixing microbe of the present disclosure.

In some aspects, the biofilm composition is a combination of two or more biofilms produced by different microorganisms. In some aspects, biofilms of the present disclosure may be comprised of or produced by a single microbial species, forming a pure culture. In some aspects, biofilms may be comprised of or produced by a consortium of bacteria. In some aspects, biofilms may be produced by one or more microbial species. In some aspects, biofilms bay be produced by at least 1, at least 2, at least 3, at least 4, at least 5, at least 6, at least 7, at least 8, at least 9, or at least 10 microbial species.

In some aspects, the biofilm is exogenous to the one or more bacteria to which it is added.

In some aspects, the biofilm is native to the one or more bacteria to which it is added.

In some aspects, the biofilm composition is a liquid. In some aspects, the biofilm composition is a solid. In some aspects, the biofilm composition comprises both solid and liquid elements. In some aspects, the biofilm composition is a semi-solid. In some aspects, the biofilm composition is dried. In some aspects the biofilm composition is a sand. In some aspects, the biofilm composition is a powder. In some aspects, the biofilm composition is a gel.

In some aspects, the biofilm composition comprises any one or more elements disclosed herein.

In some embodiments, the combination of at least two biofilms of the present disclosure exhibit a synergistic effect, on one or more of the traits described herein, in the presence of one or more of the biofilms coming into contact with one another. The synergistic effect obtained by the taught methods can be quantified, for example, according to Colby's formula (i.e., (E)=X+Y−(X*Y/100)). See Colby, R. S., "Calculating Synergistic and Antagonistic Responses of Herbicide Combinations," 1967. Weeds. Vol. 15, pp. 20-22, incorporated herein by reference in its entirety.

Thus, "synergistic" is intended to reflect an outcome/parameter/effect that has been increased by more than an additive amount.

In some aspects, the biofilms are introduced to liquid media comprising any one or more bacteria of the present disclosure. In some aspects, the biofilms are introduced to liquid media comprising any one or more bacteria of the present disclosure at a % volume of at least 5%, 10%, 15%, 20%, 25%, 30%, 35%, 40%, 45%, 504/o, 55%, 60%, 65%, 70%, 75%, 804/o, 85%, or 904/o In some aspects, the biofilms are introduced to liquid media comprising any one or more bacteria at a volume of 1:1, 2:1, 3:1, 4:1, 5:1, 6:1, 7:1, 8:1, 9: or 10:1.

Moisture content is a measurement of the total amount of water in a composition, usually expressed as a percentage of the total weight. The moisture content is a useful measurement for determining the dry weight of a composition, and it can be used to confirm whether the desiccation/drying process of a composition is complete. The moisture content is calculated by dividing the (wet weight of the composition minus the weight after desiccating/drying) by the wet weight of the composition, and multiplying by 100.

Moisture content defines the amount of water in a composition, but water activity explains how the water in the composition will react with microorganisms. The greater the water activity, the faster microorganisms are able to grow. Water activity is calculated by finding the ratio of the vapor pressure in a composition to the vapor pressure of pure water. More specifically, the water activity is the partial vapor pressure of water in a composition divided by the standard state partial vapor pressure of pure water. Pure distilled water has a water activity of 1. A determination of water activity of a composition is not the amount of water in a composition, rather it is the amount of excess amount of water that is available for microorganisms to use. Microorganisms have a minimal and optimal water activity for growth.

In one aspect, the biofilm compositions of the present disclosure are desiccated. A microbial composition is desiccated if the moisture content of the composition is between 0% and 20%.

In one aspect, the biofilm compositions of the present disclosure have a moisture content of about 0.5%, about 0.6%, about 0.7%, about 0.8%, about 0.9%, about 1%, about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 51%, about 52%, about 53%, about 54%, about 55%, about 56%, about 57%, about 58%, about 59%, about 60%, about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100%.

In one aspect, the biofilm compositions of the present disclosure have a moisture content of less than 0.5%, less than 0.6%, less than 0.7%, less than 0.8%, less than 0.9%, less than 1%, less than 2%, less than 3%, less than 4%, less than 5%, less than 6%, less than 7%, less than 8%, less than 9%, less than 10%, less than 11%, less than 12%, less than 13%, less than 14%, less than 15%, less than 16%, less than 17%, less than 18%, less than 19%, less than 20%, less than 21%, less than 22%, less than 23%, less than 24%, less than 25%, less than 26%, less than 27%, less than 28%, less than 29%, less than 30%, less than 31%, less than 32%, less than 33%, less than 34%, less than 35%, less than 36%, less than 37%, less than 38°%, less than 39%, less than 40%, less than 41%, less than 42%, less than 43%, less than 44%, less than 45%, less than 46%, less than 47%, less than 48%, less than 49%, less than 50%, less than 51%, less than 52%, less than 53%, less than 54%, less than 55%, less than 56%, less than 57%, less than 58%, less than 59%, less than 60%, less than 61%, less than 62%, less than 63%, less than 64%, less than 65%, less than 66%, less than 67%, less than 68%, less than 69%, less than 70%, less than 71%, less than 72%, less than 73%, less than 74%, less than 75%, less than 76%, less than 77%, less than 78%, less than 79%, less than 80%, less than 81%, less than 82%, less than 83%, less than 84%, less than 85%, less than 86%, less than 87%, less than 88%, less than 89%, less than 90%, less than 91%, less than 92%, less than 93%, less than 94%, less than 95%, less than 96%, less than 97%, less than 98%, less than 99%, or less than 100%.

In one aspect, the biofilm compositions of the present disclosure have a moisture content of less than about 0.5%, less than about 0.6%, less than about 0.7%, less than about 0.8%, less than about 0.9%, less than about 1%, less than about 2%, less than about 3%, less than about 4%, less than about 5%, less than about 6%, less than about 7%, less than about 8%, less than about 9%, less than about 10%, less than about 11%, less than about 12%, less than about 13%, less than about 14%, less than about 15%, less than about 16%, less than about 17%, less than about 18%, less than about 19%, less than about 20%, less than about 21%, less than about 22%, less than about 23%, less than about 24%, less than about 25%, less than about 26%, less than about 27%, less than about 28%, less than about 29%, less than about 30%, less than about 31%, less than about 32%, less than about 33%, less than about 34%, less than about 35%, less than about 36%, less than about 37%, less than about 38%, less than about 39%, less than about 40%, less than about 41%, less than about 42%, less than about 43%, less than about 44%, less than about 45%, less than about 46%, less than about 47%, less than about 48%, less than about 49%, less than about 50%, less than about 51%, less than about 52%, less than about 53%, less than about 54%, less than about 55%, less than about 56%, less than about 57%, less than about 58%, less than about 59%, less than about 60%, less than about 61%, less than about 62%, less than about 63%, less than about 64%, less than about 65%, less than about 66%, less than about 67%, less than about 68%, less than about 69%, less than about 70%, less than about 71%, less than about 72%, less than about 73%, less than about 74%, less than about 75%, less than about 76%, less than about 77%, less than about 78%, less than about 79%, less than about 80%, less than about 81%, less than about 82%, less than about 83%, less than about 84%, less than about 85%, less than about 86%, less than about 87%, less than about 88%, less than about 89%, less than about 90%, less than about 91%, less than about 92%, less than about 93%, less than about 94%, less than about 95%, less than about 96%, less than about 97%, less than about 98%, less than about 99%, or less than about 100%.

In one aspect, the biofilm compositions of the present disclosure have a moisture content of 1% to 100%, 1% to 95%, 1% to 90%, 1% to 85%, 1% to 80%, 1% to 75%, 1% to 70%, 1% to 65%, 1% to 60%, 1% to 55%, 1% to 50%, 1% to 45%, 1% to 40%, 1% to 35%, 1% to 30%, 1% to 25%, 1% to 20%, 1% to 15%, 1% to 10%, 1% to 5%, 5% to 100%, 5% to 95%, 5% to 90%, 5% to 85%, 5% to 80%, 5% to 75%, 5% to 70%, 5% to 65%, 5% to 60%, 5% to 55%, 5% to 50%, 5% to 45%, 5% to 40%, 5% to 35%, 54% to 34%, 5% to 25%, 5% to 20%, 5% to 15%, 5% to 10%, 10% to 100%, 10% to 95%, 10% to 90%, 10% to 85%, 10% to 80%, 10% to 75%, 10% to 70%, 10% to 65%, 10% to 60%, 10% to 55%, 10% to 504/o, 10% to 45%, 10% to 40%, 10% to 35%, 10% to 30%, 10% to 25%, 10% to 20%, 10% to 15%, 15% to 100%, 15% to 95%, 15% to 90%, 15% to 85%, 15% to 80%, 15% to 75%, 15/o to 70%, 15% to 65%, 15% to 60%, 15% to 554/o, 15% to 50%, 15% to 45%, 15% to 404/o, 15% to 35%, 15% to 30%, 15% to 25%, 15% to 20%, 204/o to 100%, 20% to 95%, 20% to 90%, 20/o to 85%, 20% to 804/o, 20% to 75%, 204/o to 70%, 20% to 65%, 20% to 60%, 20% to 55%, 20% to 50%, 20% to 45%, 20% to 40%, 20% to 35%, 20% to 30%, 20% to 25%, 25% to 100%, 25% to 95%, 25% to 90%, 25% to 85%, 25% to 80%, 25% to 75%, 25% to 70%, 25% to 65%, 25% to 60%, 25% to 55%, 25% to 50%, 25% to 45%, 25% to 40%, 25% to 35%, 25% to 30%, 30% to 100%, 30% to 95%, 30% to 90%, 30% to 85%, 30% to 80%, 30% to 75%, 30% to 70%, 30/o to 65%, 30% to 60%, 30% to 55%, 30% to 50%, 30% to 45%, 30% to 40%, 30% to 35%, 35% to 100%, 35% to 95%, 35% to 90%, 35% to 85%, 35% to 80%, 35% to 75%, 35% to 70%, 35% to 65%, 35% to 60%, 35% to 55%, 35% to 50%, 35% to 45%, 35% to 40%, 40% to 100%, 40% to 95%, 40% to 90%, 40% to 85%, 40% to 80%, 40% to 75%, 40% to 70%, 40% to 65%, 40% to 60%, 40% to 55%, 40% to 50%, 40% to 45%, 45% to 100%, 45% to 95%, 45% to 90%, 45% to 85%, 45% to 80%, 45% to 75%, 45% to 70%, 45% to 65%, 45% to 60%, 45% to 55%, 45% to 50%, 50% to 100%, 50% to 95%, 50% to 90%, 50% to 85%, 50% to 80%, 50% to 75%, 50% to 70%, 50% to 65%, 50% to 60%, 50% to 55%, 55% to 100%, 55% to 95%, 55% to 90%, 55% to 85%, 55% to 80%, 55% to 75%, 55% to 70%, 55% to 65%, 55% to 60%, 60% to 100%, 60% to 95%, 60% to 90%, 60% to 85%, 60% to 80%, 60% to 75%, 60% to 70%, 60% to 65%, 65% to 100%, 65% to 95%, 65% to 90%, 65% to 85%, 65% to 80%, 65% to 75%, 65% to 70%, 70% to 100%, 70% to 95%, 70% to 90%, 70% to 85%, 70% to 80%, 70% to 75%, 75% to 100%, 75% to 95%, 75% to 90%, 75% to 85%, 75% to 80%, 80% to 100%, 80% to 95%, 80% to 90%, 80% to 85%, 85% to 100%, 85% to 95%, 85% to 90%, 90% to 1004/o, 90% to 95%, or 95% to 100%.

In one aspect, the biofilm compositions of the present disclosure have a water activity of about 0.1, about 0.15, about 0.2, about 0.25, about 0.30, about 0.35, about 0.4, about 0.5, about 0.55, about 0.60, about 0.65, about 0.70, about 0.75, about 0.8, about 0.85, about 0.90, or about 0.95.

In one aspect, the biofilm compositions of the present disclosure have a water activity of less than about 0.1, less than about 0.15, less than about 0.2, less than about 0.25, less than about 0.30, less than about 0.35, less than about 0.4, less than about 0.5, less than about 0.55, less than about 0.60, less than about 0.65, less than about 0.70, less than about 0.75, less than about 0.8, less than about 0.85, less than about 0.90, or less than about 0.95.

In one aspect, the biofilm compositions of the present disclosure have a water activity of less than 0.1, less than 0.15, less than 0.2, less than 0.25, less than 0.30, less than 0.35, less than 0.4, less than 0.5, less than 0.55, less than 0.60, less than 0.65, less than 0.70, less than 0.75, less than 0.8, less than 0.85, less than 0.90, or less than 0.95.

In one aspect, the biofilm compositions of the present disclosure have a water activity of 0.1 to 0.95, 0.1 to 0.90, 0.1 to 0.85, 0.1 to 0.8, 0.1 to 0.75, 0.1 to 0.70, 0.1 to 0.65, 0.1 to 0.55, 0.1 to 0.50, 0.1 to 0.45, 0.1 to 0.40, 0.1 to 0.35, 0.1 to 0.3, 0.1 to 0.25, 0.1 to 0.2, 0.1 to 0.15, 0.15 to 0.95, 0.15 to 0.90, 0.15 to 0.85, 0.15 to 0.8, 0.15 to 0.75, 0.15 to 0.70, 0.15 to 0.65, 0.15 to 0.55, 0.15 to 0.50, 0.15 to 0.45, 0.15 to 0.40, 0.15 to 0.35, 0.15 to 0.3, 0.15 to 0.25, 0.15 to 0.2, 0.2 to 0.95, 0.2 to 0.90, 0.2 to 0.85, 0.2 to 0.8, 0.2 to 0.75, 0.2 to 0.70, 0.2 to 0.65, 0.2 to 0.55, 0.2 to 0.50, 0.2 to 0.45, 0.2 to 0.40, 0.2 to 0.35, 0.2 to 0.3, 0.2 to 0.25, 0.25 to 0.95, 0.25 to 0.90, 0.25 to 0.85, 0.25 to 0.8, 0.25 to 0.75, 0.25 to 0.70, 0.25 to 0.65, 0.25 to 0.55, 0.25 to 0.50, 0.25 to 0.45, 0.25 to 0.40, 0.25 to 0.35, 0.25 to 0.3, 0.3 to 0.95, 0.3 to 0.90, 0.3 to 0.85, 0.3 to 0.8, 0.3 to 0.75, 0.3 to 0.70, 0.3 to 0.65, 0.3 to 0.55, 0.3 to 0.50, 0.3 to 0.45, 0.3 to 0.40, 0.3 to 0.35, 0.35 to 0.95, 0.35 to 0.90, 0.35 to 0.85, 0.35 to 0.8, 0.35 to 0.75, 0.35 to 0.70, 0.35 to 0.65, 0.35 to 0.55, 0.35 to 0.50, 0.35 to 0.45, 0.35 to 0.40, 0.4 to 0.95, 0.4 to 0.90, 0.4 to 0.85, 0.4 to 0.8, 0.4 to 0.75, 0.4 to 0.70, 0.4 to 0.65, 0.4 to 0.55, 0.4 to 0.50, 0.4 to 0.45, 0.45 to 0.95, 0.45 to 0.90, 0.45 to 0.85, 0.45 to 0.8, 0.45 to 0.75, 0.45 to 0.70, 0.45 to 0.65, 0.45 to 0.55, 0.45 to 0.50, 0.5 to 0.95, 0.5 to 0.90, 0.5 to 0.85, 0.5 to 0.8, 0.5 to 0.75, 0.5 to 0.70, 0.5 to 0.65, 0.5 to 0.55, 0.55 to 0.95, 0.55 to 0.90, 0.55 to 0.85, 0.55 to 0.8, 0.55 to 0.75, 0.55 to 0.70, 0.55 to 0.65, 0.6 to 0.95, 0.6 to 0.90, 0.6 to 0.85, 0.6 to 0.8, 0.6 to 0.75, 0.6 to 0.70, 0.65 to 0.95, 0.65 to 0.90, 0.65 to 0.85, 0.65 to 0.8, 0.65 to 0.75, 0.7 to 0.95, 0.7 to 0.90, 0.7 to 0.85, 0.7 to 0.8, 0.75 to 0.95, 0.75 to 0.90, 0.75 to 0.85, 0.8 to 0.95, 0.8 to 0.90, 0.8 to 0.85, 0.85 to 0.95, 0.85 to 0.90, or 0.9 to 0.95.

(i) Seed Coatings

In some aspects, the biofilm composition is applied to plant seed. In some aspects, the biofilm composition is applied to seeds of corn, soybean, canola, sorghum, potato, rice, vegetables, cereals, pseudocereals, and oilseeds. Examples of cereals may include barley, fonio, oats, palmer's grass, rye, pearl millet, sorghum, spelt, teff, triticale, and wheat. Examples of pseudocereals may include breadnut, buckwheat, cattail, chia, flax, grain amaranth, hanza, quinoa, and sesame. In some examples, seeds can be genetically modified organisms (GMO), non-GMO, organic, or conventional.

In some aspects, the biofilm composition is applied to plant seed by coating the seed with a liquid, slurry, or powder comprising the biofilm composition. In some aspects, the seed coating is a dry seed coating. In some aspects, the seed coating is a wet seed coating. In some aspects, the seed coating is applied wet and is allowed to dry on the seed.

Administering the Biofilm Composition

The biofilm composition described herein can be applied in furrow, in talc, or as a seed treatment. The biofilm composition can be applied to a seed package in bulk, mini bulk, in a bag, or in talc.

The planter can plant the treated seed and grows the crop according to conventional ways, twin row, or ways that do not require tilling. The seeds can be distributed using a control hopper or an individual hopper. Seeds can also be distributed using pressurized air or manually. Seed placement can be performed using variable rate technologies. Additionally, application of the bacteria or bacterial population described herein may be applied using variable rate technologies. In some examples, the bacteria can be applied to plant seeds of the present disclosure.

Additives such as micro-fertilizer, PGR, herbicide, insecticide, and fungicide can be used additionally to treat the crops. Examples of additives include crop protectants such as insecticides, nematicides, fungicide, enhancement agents such as colorants, polymers, pelleting, priming, and disinfectants, and other agents such as inoculant, PGR, softener, and micronutrients. PGRs can be natural or synthetic plant hormones that affect root growth, flowering, or stem elongation. PGRs can include auxins, gibberellins, cytokinins, ethylene, and abscisic acid (ABA).

The composition can be applied in furrow in combination with liquid fertilizer. In some examples, the liquid fertilizer may be held in tanks. NPK fertilizers contain macronutrients of sodium, phosphorous, and potassium.

Biofilm Conferred Viability

In some aspects, "viability," "microbial viability," or "cellular viability" refers to the percentage of cells that are capable of growth on solid or liquid growth medium. In some aspects, viability refers to at least 1%, 2%, 3%, 4%, 5%, 6%, 7%, 8%, 15%, 16%, 17%, 18%, 19%, 20%, 21%, 22%, 23%, 24%, 25%, 32%, 33%, 34%, 35%, 36%, 37%, 38%, 39%, 40%, 41%, 42%, 50%, 51%, 52%, 53%, 54%, 55%, 56%, 57%, 58%, 59%, 60%, 67%, 68%, 69%, 70%, 71%, 72%, 73%, 74%, 75%, 76%, 77%, 84%, 85%, 86%, 87%, 88%, 89%, 90%, 91%, 92%, 93%, 94%, 95%, 96%, 97%, 98%, 99%, or 100% of the total number of cells that remain viable in a sample, as compared to a corresponding reference/control composition.

In some aspects, the biofilm-comprising microbial composition exhibits an increased cellular viability for a longer period of time as compared to a control microbial composition lacking the biofilm.

In some aspects, the biofilm-comprising microbial composition exhibits an increased cellular viability as compared to a control microbial composition lacking the biofilm. In some aspects, the biofilm-comprising microbial composition exhibits an increase in viability of at least 5%, 15%, 20%, 25%, 30%, 35%, 40%, 45%, 50%, 55%, 60%, 65%, 70%, 75%, 80%, 85%, 90%, 95%, 100%, 125%, 150%, 175%, 200%, 250%, 300%, 350%, 400%, 450%, 500%, 550%, 600%, 700%, 800%, or 900% as compared to a corresponding reference/control composition over the same period of time.

In some aspects, the period of time is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 105, 110, 120, 130, 140, 150, 160, 170, 180, 190, 200, 210, 220, 230, 240, or 250 days post-manufacture of the biofilm-comprising microbial composition or the corresponding reference/control composition.

In some aspects, the biofilm-comprising microbial composition exhibits a viability of at least 20%, 30%, 40%, 50%, 60%, 70%, 75%, 80%, 904/0, or 95% in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days, as compared to a corresponding reference/control composition over the same period of time.

In some aspects, the biofilm-comprising microbial composition exhibits a viability of at least 20%, 30%, 40%, 50%, 604/0, 70%, 75%, 80%, 90%, or 95% in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks, as compared to a corresponding reference/control composition over the same period of time.

In some aspects, the biofilm-comprising microbial composition exhibits a viability of at least 20%, 30%, 40%, 50%, 60%, 704/0, 75%, 80%, 904/0, or 95% at room temperature (68-72° F.) fora period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days, as compared to a corresponding reference/control composition over the same period of time.

In some aspects, the biofilm-comprising microbial composition exhibits a viability of at least 20%, 30%, 40%, 50%, 60%, 70%, 75%, 80%, 90%, or 95% at room temperature (68-72° F.) fora period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks, as compared to a corresponding reference/control composition over the same period of time.

In some aspects, the biofilm-comprising microbial composition exhibits a viability of at least 20%, 30%, 40%, 50%, 60%, 70%, 75%, 80%, 90%, or 95% at 70-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days, as compared to a corresponding reference/control composition over the same period of time.

In some aspects, the biofilm-comprising microbial composition exhibits a viability of at least 20%, 30%, 40%, 50%, 60%, 70%, 75%, 80%, 90%, or 95% at 70-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks, as compared to a corresponding reference/control composition over the same period of time.

In some aspects, the biofilm-comprising microbial composition exhibits a viability of at least 20%, 30%, 40%, 50%, 60%, 70%, 75%, 80%, 90%, or 95% at a temperature below −20° F.) fora period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days, as compared to a corresponding reference/control composition over the same period of time.

In some aspects, the biofilm-comprising microbial composition exhibits a viability of at least 20%, 30%, 40%, 50%, 60%, 70%, 75%, 80%, 90%, or 95% at a temperature below −20° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks, as compared to a corresponding reference/control composition over the same period of time.

In some aspects, the biofilm-comprising microbial composition exhibits an increased in-jug stability, an increased on seed stability, an increased in furrow stability, and/or an increased in talc stability as compared to a control microbial composition lacking the biofilm. In some aspects, an increase in stability is measured in terms of viability.

In some aspects, the biofilm-comprising microbial composition exhibits an increase in stability, for e.g., in jug stability, on seed stability, in furrow stability, or in talc stability (for e.g., as reflected by increased cellular viability) at higher temperatures such as, 30° C., 37° C., 45° C., or 60° C., compared to a control microbial composition lacking the biofilm.

In some aspects, the biofilm-comprising microbial composition exhibits an increase in stability such as an increase in jug stability, on seed stability, in furrow stability, or in talc stability (for e.g., as reflected by increased cellular viability) by at least 5%, 10%, 15%, 20%, 25%, 30%, 35%, 40%, 45%, 50%, 55%, 60%, 65%, 70%, 75%, 80%, 85%, 90%, or 95% at higher temperatures such as, 30° C., 37° C., 45° C., or 60° C., for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks, compared to a corresponding reference/control composition lacking the biofilm stored under the same conditions.

In some aspects, the biofilm-comprising microbial composition exhibits an increase in stability, for e.g., an increase in in jug stability, on seed stability, in furrow stability, or in talc stability (for e.g., as reflected by increased cellular viability) by at least 5%, 10%, 15%, 20%, 25%, 30%, 35%, 40%, 45%, 50%, 55%, 60%, 65%, 70%, 75%, 80%, 85%, 90%, or 95% at higher temperatures such as, 30° C., 37° C., 45° C., or 60° C., for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days, compared to a corresponding reference/control composition lacking the biofilm stored under the same conditions.

In some aspects, the biofilm-comprising microbial composition exhibits an increased viability when subjected to desiccating conditions, as compared to a corresponding reference/control composition. In some aspects, the biofilm-comprising microbial composition exhibits an increased viability when subjected to freeze drying, as compared to a corresponding reference/control composition. In some aspects, the biofilm-comprising microbial composition exhibits an increased viability when subjected to spray drying, as compared to a corresponding reference/control composition. In some aspects, the biofilm-comprising microbial composition exhibits an increased viability when subjected to lyophilization, as compared to a corresponding reference/control composition. In some aspects, the biofilm-comprising microbial composition exhibits an increased viability when subjected to spray congealing, as compared to a corresponding reference/control composition.

EXAMPLES

The following examples are given for the purpose of illustrating various embodiments of the disclosure and are not meant to limit the present disclosure in any fashion. Changes therein and other uses which are encompassed within the spirit of the disclosure, as defined by the scope of the claims, will be recognized by those skilled in the art.

Example 1: Guided Microbial Remodeling—A Platform for the Rational Improvement of Microbial Species for Agriculture An example overview of an embodiment of the Guided Microbial Remodeling (GMR) platform can be summarized in the schematic of FIG. 1A.

FIG. 1A illustrates that the composition of the microbiome can first be characterized and a species of interest is identified (e.g. to find a microbe with the appropriate colonization characteristics).

The metabolism of the species of interest can be mapped and linked to genetics. For example, the nitrogen fixation pathway of the microbe can be characterized. The pathway that is being characterized can be examined under a range of environmental conditions. For example, the microbe's ability to fix atmospheric nitrogen in the presence of various levels of exogenous nitrogen in its environment can be examined. The metabolism of nitrogen can involve the entrance of ammonia ($NH_4^+$) from the rhizosphere into the cytosol of the bacteria via the AmtB transporter. Ammonia and L-glutamate (L-Glu) are catalyzed by glutamine synthetase and ATP into glutamine. Glutamine can lead to the formation of bacterial biomass and it can also inhibit expression of the nif operon, i.e. it can be a competing force when one desires the microbe to fix atmospheric nitrogen and excrete ammonia. The nitrogen fixation pathway is characterized in great detail in earlier sections of the specification.

Afterwards, a targeted non-intergeneric genomic alteration can be introduced to the microbe's genome, using methods including, but not limited to: conjugation and recombination, chemical mutagenesis, adaptive evolution, and gene editing. The targeted non-intergeneric genomic alteration can include an insertion, disruption, deletion, alteration, perturbation, modification, etc. of the genome.

Derivative remodeled microbes, which comprise the desired phenotype resulting from the remodeled underlying genotype, are then used to inoculate crops.

The present disclosure provides, in certain embodiments, non-intergeneric remodeled microbes that are able to fix atmospheric nitrogen and supply such nitrogen to a plant. In aspects, these non-intergeneric remodeled microbes are able to fix atmospheric nitrogen, even in the presence of exogenous nitrogen.

Figure 1B:
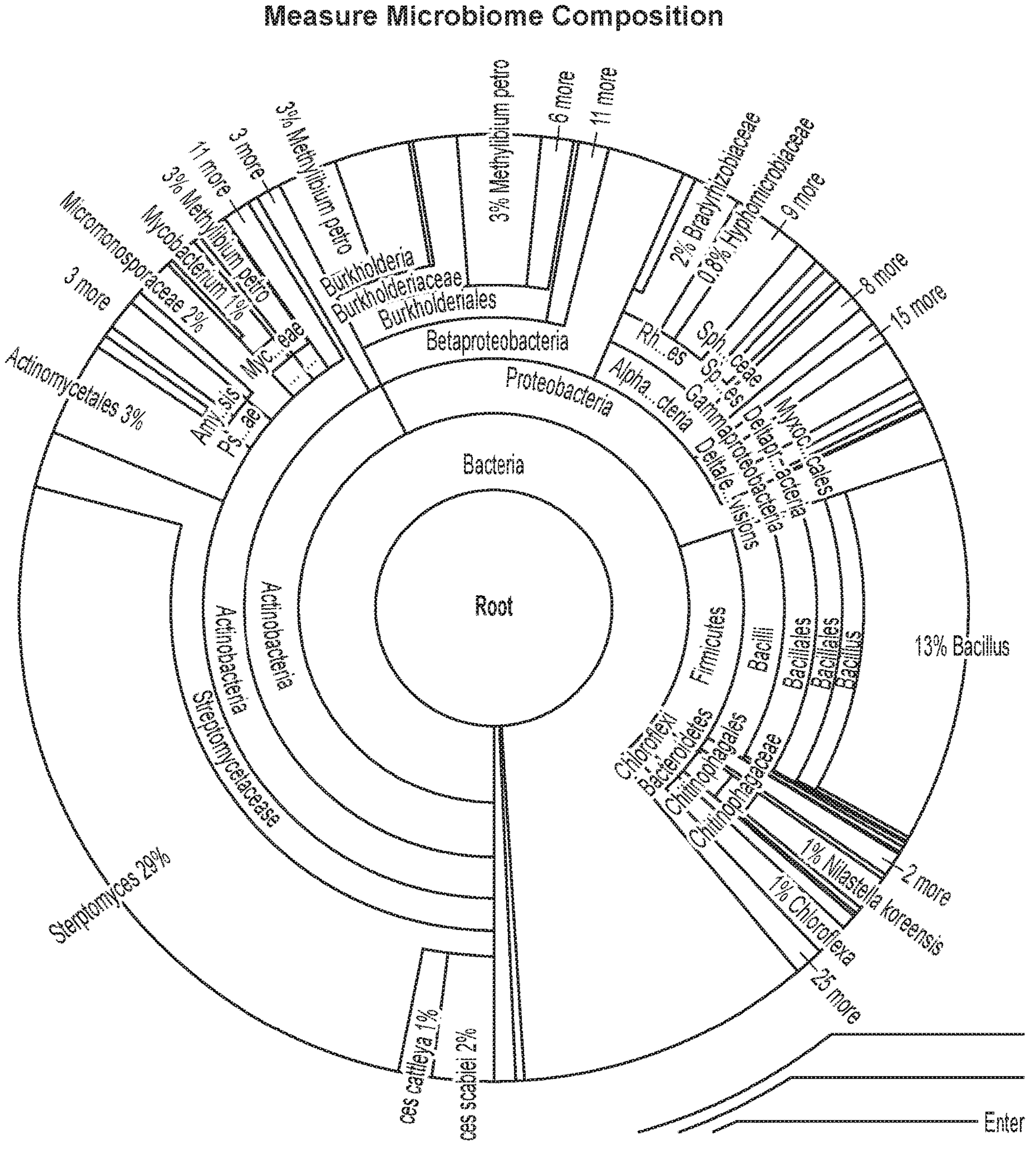
FIG. 1B depicts an expanded view of the measurement of microbiome composition as shown in FIG. 1A.
Figure 1C:
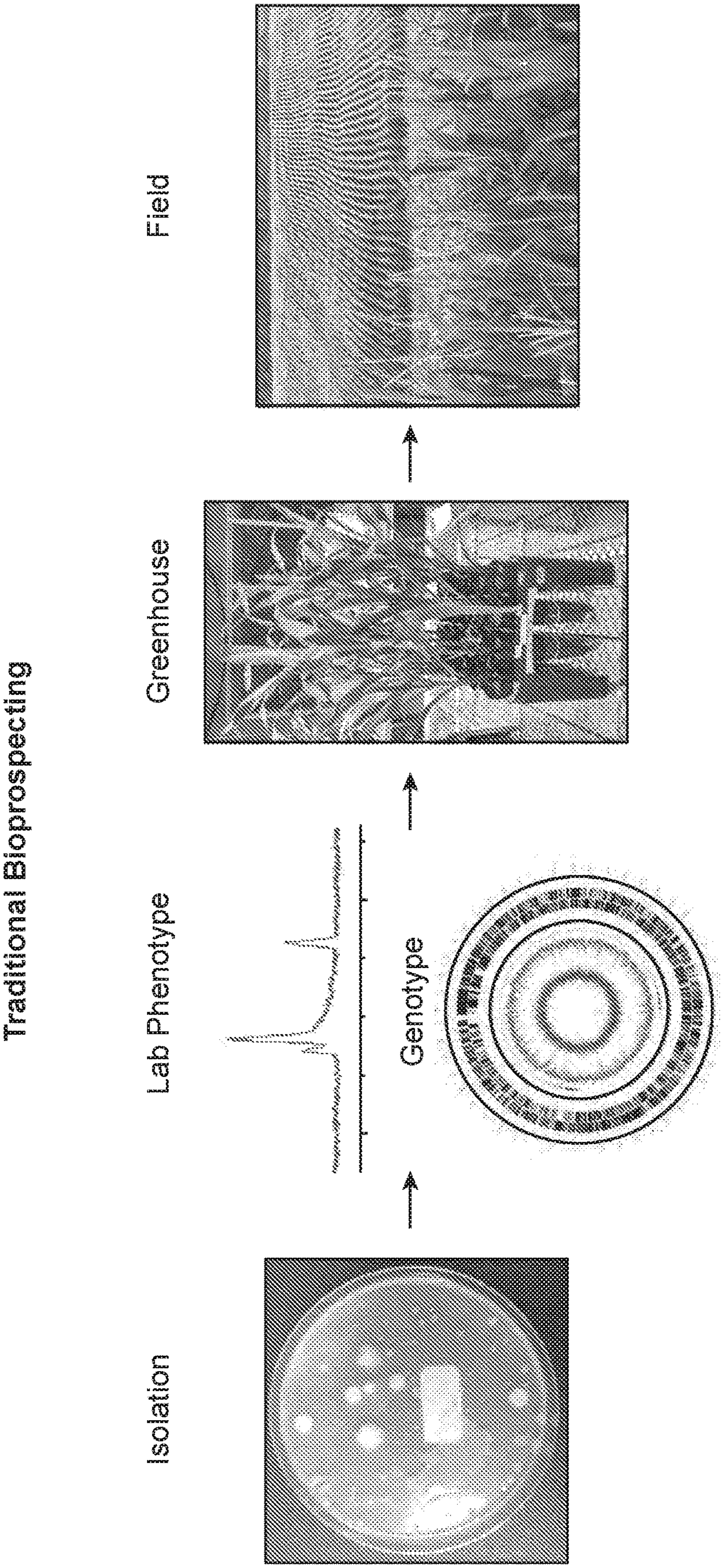
FIG. 1C depicts a problematic "traditional bioprospecting" approach, which has several drawbacks compared to the taught guided microbial remodeling (GMR) platform.
Figure 1D:
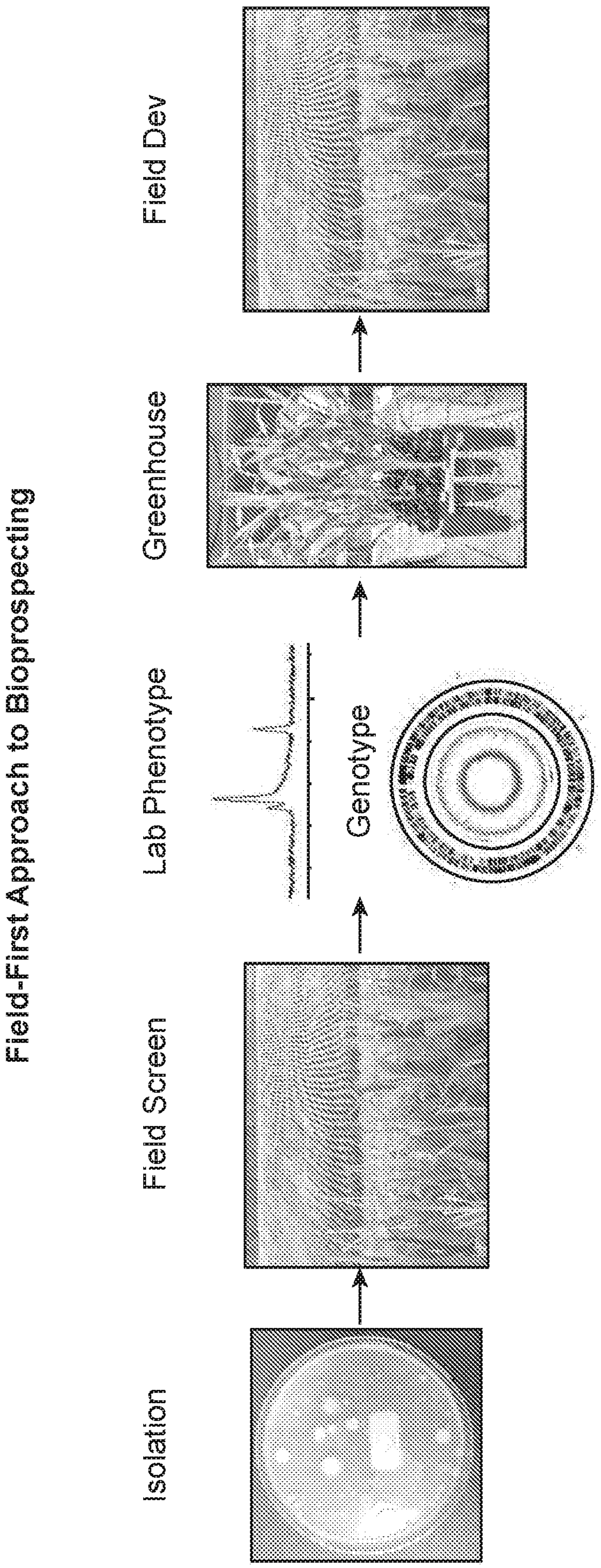
FIG. 1D depicts a problematic "field-first approach to bioprospecting" system, which has several drawbacks compared to the taught guided microbial remodeling (GMR) platform.
Figure 1E:
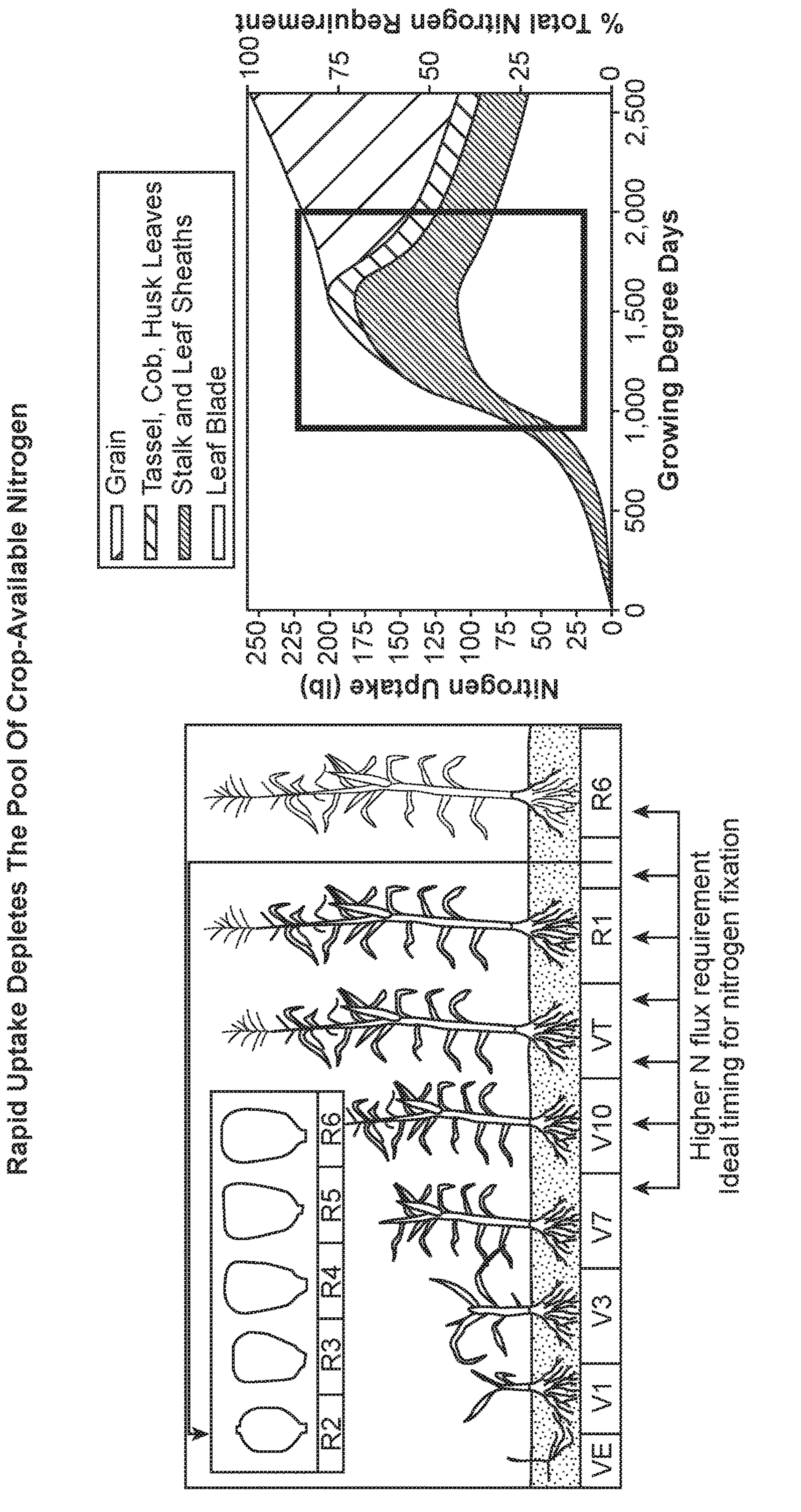
FIG. 1E depicts the time period in the corn growth cycle, at which nitrogen is needed most by the plant.
Figure 1F:
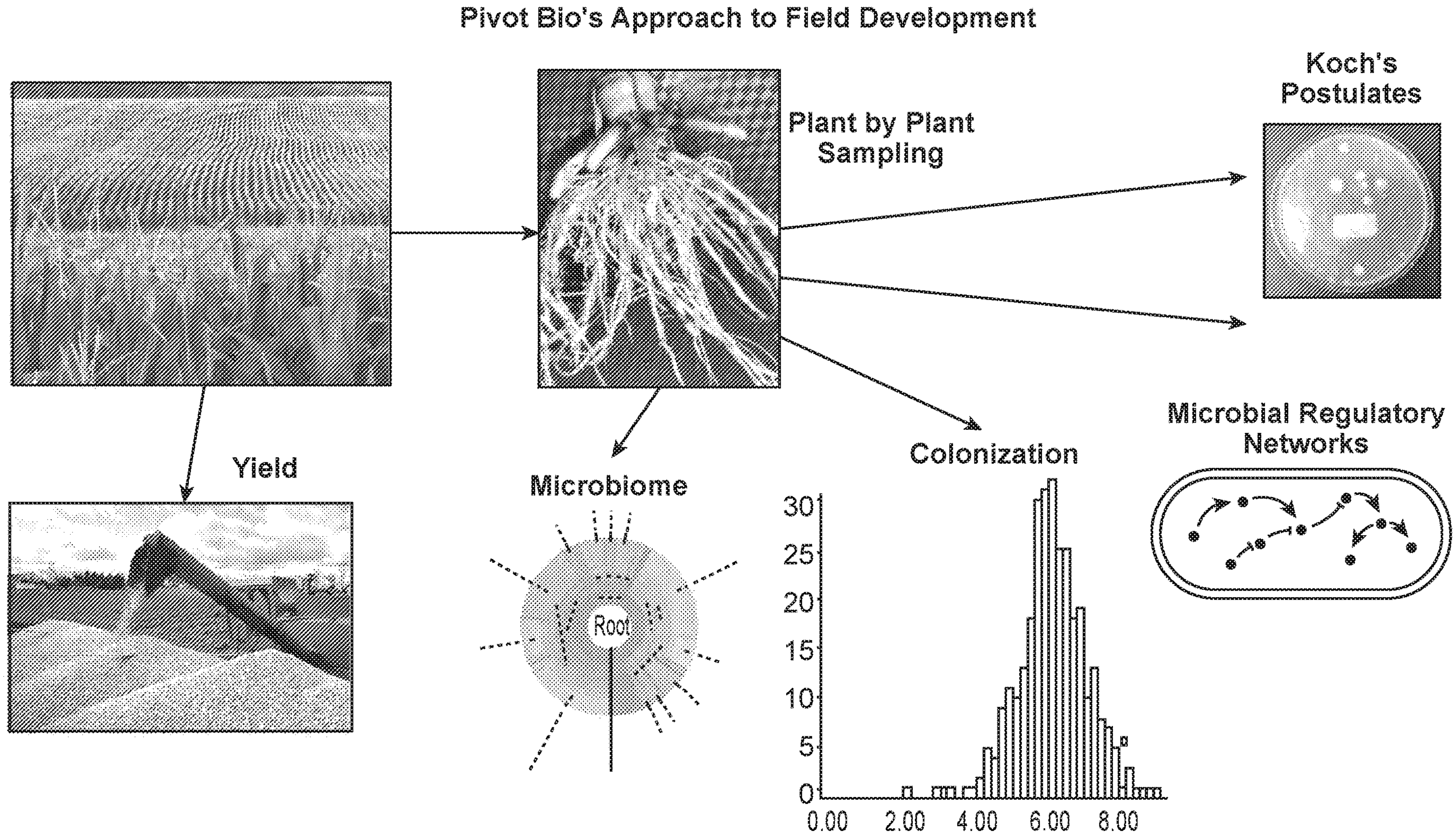
FIG. 1F depicts an overview of a field development process for a remodeled microbe.
Figure 1G:
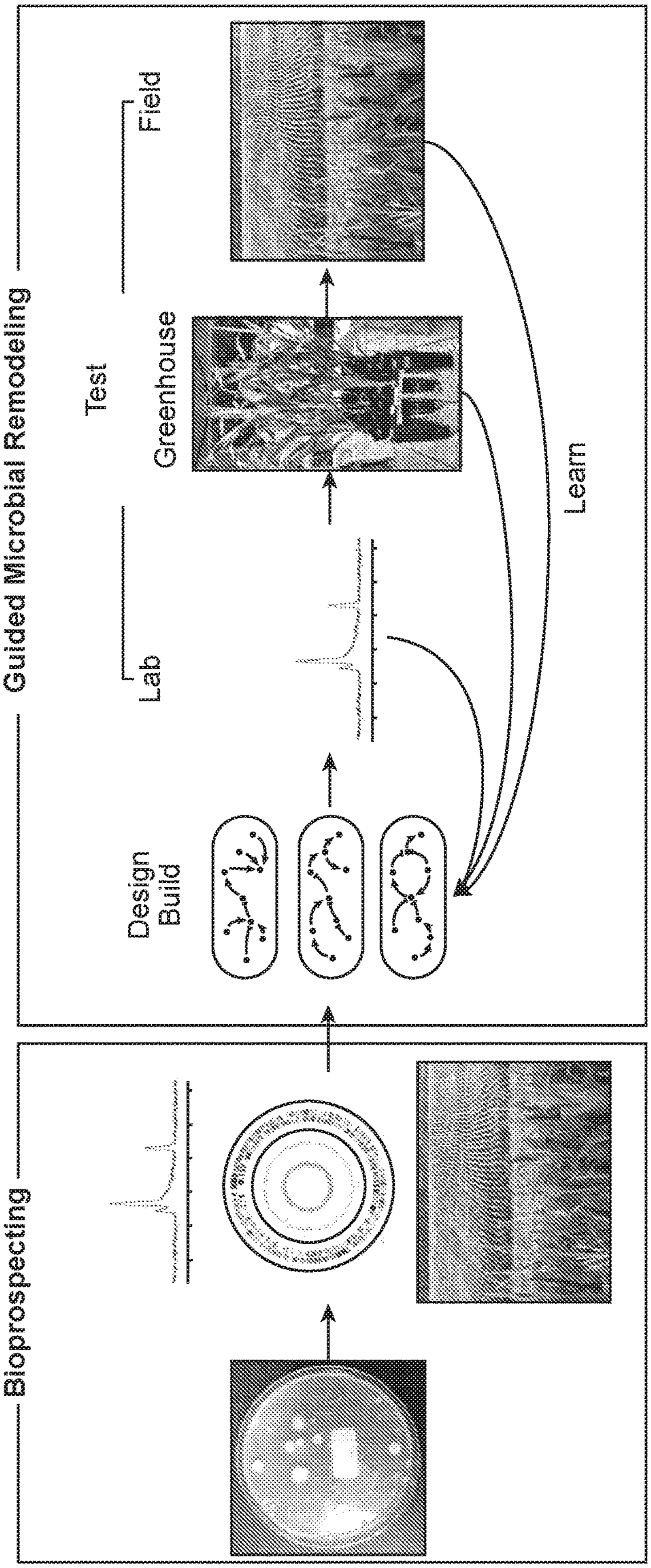
FIG. 1G depicts an overview of a guided microbial remodeling platform embodiment.
Figure 1H:
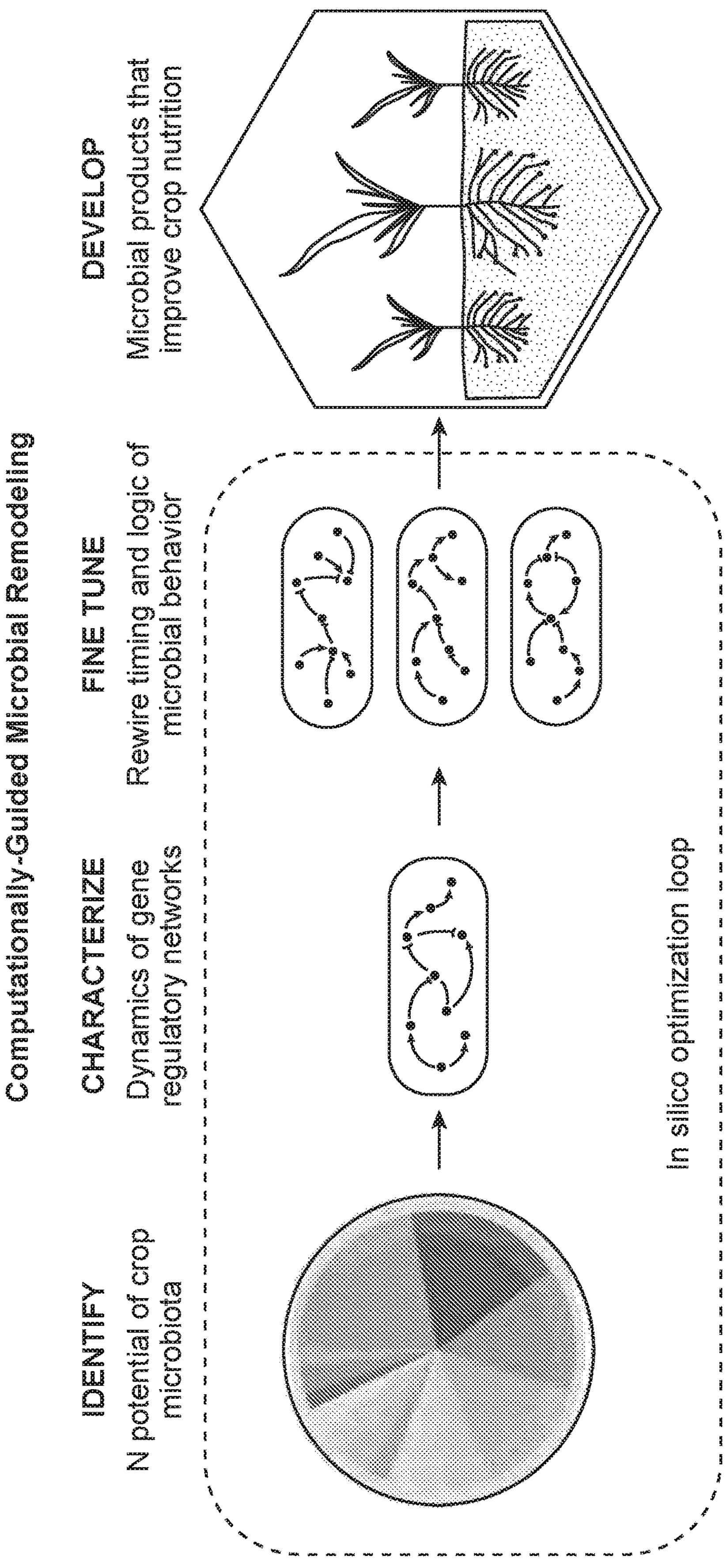
FIG. 1H depicts an overview of a computationally-guided microbial remodeling platform.
Figure 1I:
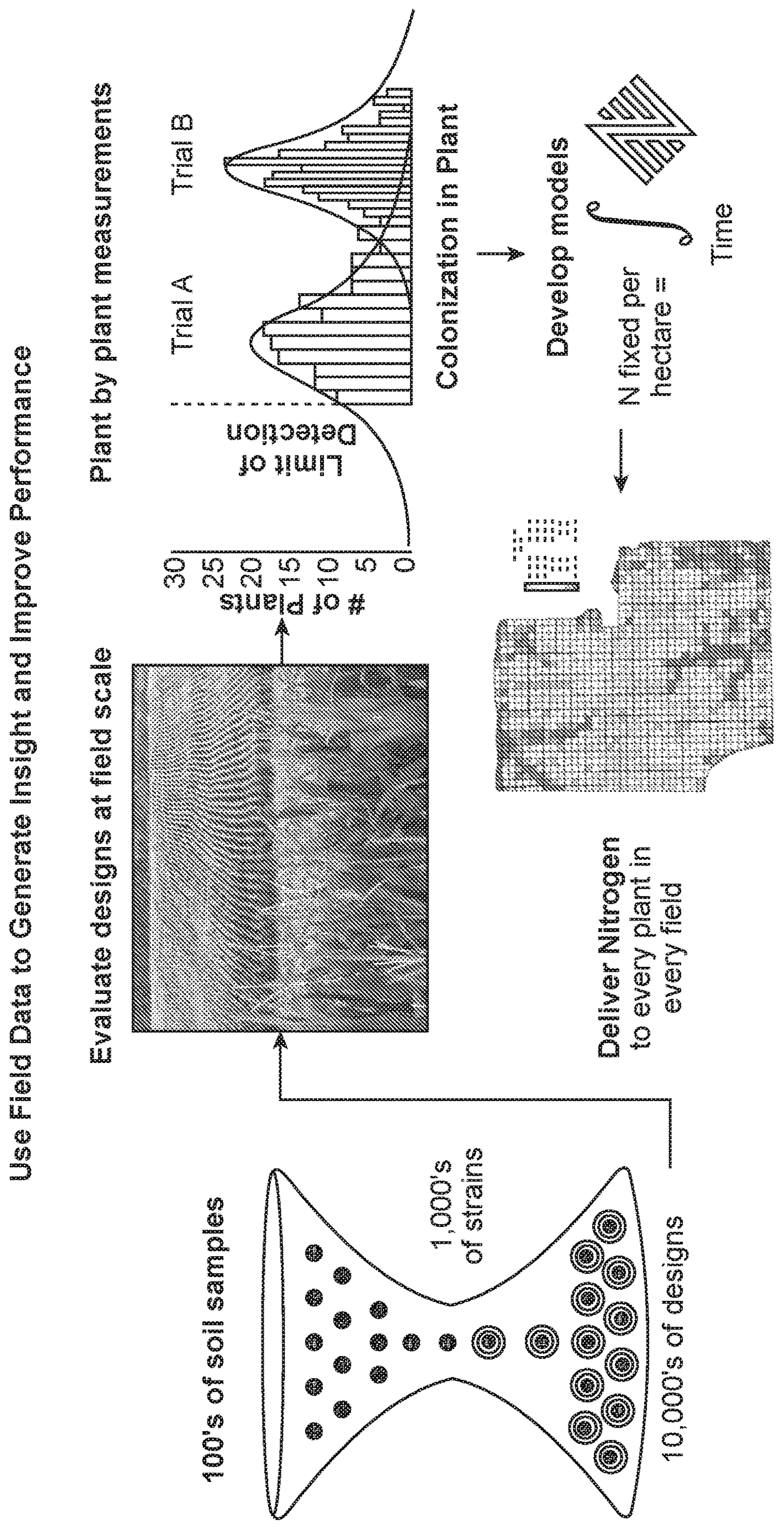
FIG. 1I depicts the use of field data combined with modeling in aspects of the guided microbial remodeling platform.

FIG. 1B depicts an expanded view of the measurement of the microbiome step. In some embodiments, the present disclosure finds microbial species that have desired colonization characteristics, and then utilizes those species in the subsequent remodeling process.

The aforementioned Guided Microbial Remodeling (GMR) platform will now be described with more specificity.

In aspects, the GMR platform comprises the following steps:

A. Isolation—Obtain microbes from the soil, rhizosphere, surface, etc. of a crop plant of interest;

B. Characterization—Involves characterizing the isolated microbes for genotype/phenotypes of interest (e.g. genome sequence, colonization ability, nitrogen fixation activity, solubilization of P ability, excretion of a metabolite of interest, excretion of a plant promoting compound, etc.)

C. Domestication—Development of a molecular protocol for non-intergeneric genetic modification of the microbe;

D. Non-Intergeneric Engineering Campaign and Optimization—Generation of derivative non-intergeneric microbial strains with genetic modifications in key pathways (e.g. colonization associated genes, nitrogen fixation/assimilation genes, P solubilization genes);

E. Analytics—Evaluation of derived non-intergeneric strains for phenotypes of interest both in vitro (e.g. ARA assays) and in plants (e.g. colonization assays).

F. Iterate Engineering Campaign/Analytics—Iteration of steps D and E for further improvement of microbial strain.

Each of the GMR platform process steps will now be elaborated upon below.

A. Isolation of Microbes

1. Obtain a Soil Sample

Microbes will be isolated from soil and/or roots of a plant. In one example, plants will be grown in a laboratory or a greenhouse in small pots. Soil samples will be obtained from various agricultural areas. For example, soils with diverse texture characteristics can be collected, including loam (e.g. peaty clay loam, sandy loam), clay soil (e.g. heavy clay, silty clay), sandy soil, silty soil, peaty soil, chalky soil, and the like.

2. Grow Bait Plants

Seeds of a bait plant (a plant of interest) (e.g. corn, wheat, rice, sorghum, millet, soybean, vegetables, fruits, etc.) will be planted into each soil type. In one example, different varieties of a bait plant will be planted in various soil types. For example, if the plant of interest is corn, seeds of different varieties of corn such as field corn, sweet corn, heritage corn, etc. will be planted in various soil types described above.

3. Harvest Soil and/or Root Samples and Plate on Appropriate Medium

Plants will be harvested by uprooting them after a few weeks (e.g. 2-4 weeks) of growth. Alternative to growing plants in a laboratory/greenhouse, soil and/or roots of the plant of interest can be collected directly from the fields with different soil types.

To isolate rhizosphere microbes and epiphytes, plants will be removed gently by saturating the soil with distilled water or gently loosening the soil by hand to avoid damage to the roots. If larger soil particles are present, these particles will be removed by submerging the roots in a still pool of distilled water and/or by gently shaking the roots. The root will be cut and a slurry of the soil sticking to the root will be prepared by placing the root in a plate or tube with small amount of distilled water and gently shaking the plate/tube on a shaker or centrifuging the tube at low speed. This slurry will be processed as described below.

To isolate endophytes, excess soil on root surfaces will be removed with deionized water. Following soil removal, plants will be surface sterilized and rinsed vigorously in sterile water. A cleaned, 1 cm section of root will be excised from the plant and placed in a phosphate buffered saline solution containing 3 mm steel beads. A slurry will be generated by vigorous shaking of the solution with a Qiagen TissueLyser II.

The soil and/or root slurry can be processed in various ways depending on the desired plant-beneficial trait of microbes to be isolated. For example, the soil and root slurry can be diluted and inoculated onto various types of screening media to isolate rhizospheric, endophytic, epiphytic, and other plant-associated microbes. For example, if the desired plant-beneficial trait is nitrogen fixation, then the soil/root slurry will be plated on a nitrogen free media (e.g. Nfb agar media) to isolate nitrogen fixing microbes. Similarly, to isolate phosphate solubilizing bacteria (PSB), media containing calcium phosphate as the sole source of phosphorus can be used. PSB can solubilize calcium phosphate and assimilate and release phosphorus in higher amounts. This reaction is manifested as a halo or a clear zone on the plate and can be used as an initial step for isolating PSB.

4. Pick Colonies, Purify Cultures, and Screen for the Presence of Genes of Interest Populations of microbes obtained in step A3 are streaked to obtain single colonies (pure cultures). A part of the pure culture is resuspended in a suitable medium (e.g. a mixture of R2A and glycerol) and subjected to PCR analysis to screen for the presence of one or more genes of interest. For example, to identify nitrogen fixing bacteria (diazotrophs), purified cultures of isolated microbes can be subjected to a PCR analysis to detect the presence of nif genes that encode enzymes involved in the fixation of atmospheric nitrogen into a form of nitrogen available to living organisms.

5. Bank a Purified Culture

Purified cultures of isolated strains will be stored, for example at −80° C., for future reference and analysis.

B. Characterization of Isolated Microbes

1. Phylogenetic Characterization and Whole Genome Sequencing

Isolated microbes will be analyzed for phylogenetic characterization (assignment of genus and species) and the whole genome of the microbes will be sequenced.

For phylogenetic characterization, 16S rDNA of the isolated microbe will be sequenced using degenerate 16S rDNA primers to generate phylogenetic identity. The 16S rDNA sequence reads will be mapped to a database to initially assign the genus, species and strain name for isolated microbes. Whole genome sequencing is used as the final step to assign phylogenetic genus/species to the microbes.

The whole genome of the isolated microbes will be sequenced to identify key pathways. For the whole genome sequencing, the genomic DNA will be isolated using a genomic DNA isolation kit (e.g. QIAmp DNA mini kit from QIAGEN) and a total DNA library will be prepared using the methods known in the art. The whole genome will be sequenced using high throughput sequencing (also called Next Generation Sequencing) methods known in the art. For example, Illumina, Inc., Roche, and Pacific Biosciences provide whole genome sequencing tools that can be used to prepare total DNA libraries and perform whole genome sequencing.

The whole genome sequence for each isolated strain will be assembled; genes of interest will be identified; annotated; and noted as potential targets for remodeling. The whole genome sequences will be stored in a database.

2. Assay the Microbe for Colonization of a Host Plant in a Greenhouse

Isolated microbes will be characterized for the colonization of host plants in a greenhouse. For this, seeds of the desired host plant (e.g., corn, wheat, rice, sorghum, soybean) will be inoculated with cultures of isolated microbes individually or in combination and planted into soil. Alternatively, cultures of isolated microbes, individually or in combination, can be applied to the roots of the host plant by inoculating the soil directly over the roots. The colonization potential of the microbes will be assayed, for example, using a quantitative PCR (qPCR) method described in a greater detail below.

3. Assay the Microbe for Colonization of the Host Plant in Small-Scale Field Trials and Isolate RNA from Colonized Root Samples (CAT Trials)

Isolated microbes will be assessed for colonization of the desired host plant in small-scale field trials. Additionally, RNA will be isolated from colonized root samples to obtain transcriptome data for the strain in a field environment. These small-scale field trials are referred to herein as CAT (Colonization and Transcript) trials, as these trials provide Colonization and Transcript data for the strain in a field environment.

For these trials, seeds of the host plant (e.g., corn, wheat, rice, sorghum, soybean) will be inoculated using cultures of isolated microbes individually or in combination and planted into soil. Alternatively, cultures of isolated microbes, individually or in combination, can be applied to the roots of the host plant by inoculating the soil directly over the roots. The CAT trials can be conducted in a variety of soils and/or under various temperature and/or moisture conditions to assess the colonization potential and obtain transcriptome profile of the microbe in various soil types and environmental conditions.

Colonization of roots of the host plant by the inoculated microbe(s) will be assessed, for example, using a qPCR method as described below.

In one protocol, the colonization potential of isolated microbes was assessed as follows. One day after planting of corn seeds, 1 ml of microbial overnight culture (SOB media) was drenched right at the spot of where the seed was located. 1 mL of this overnight culture was roughly equivalent to about 10^9 cfu, varying within 3-fold of each other, depending on which strain is being used. Each seedling was fertilized 3× weekly with 50 mL modified Hoagland's solution supplemented with either 2.5 mM or 0.25 mM ammonium nitrate. At four weeks after planting, root samples were collected for DNA extraction. Soil debris were washed away using pressurized water spray. These tissue samples were then homogenized using QIAGEN Tissuelyzer and the DNA was then extracted using QIAmp DNA Mini Kit (QIAGEN) according to the recommended protocol. qPCR assay was performed using Stratagene Mx3005P RT-PCR on these DNA extracts using primers that were designed (using NCBI's Primer BLAST) to be specific to a loci in each of the microbe's genome.

The presence of the genome copies of the microbe was quantified, which reflected the colonization potential of the microbe. Identity of the microbial species was confirmed by sequencing the PCR amplification products.

Additionally, RNA will be isolated from colonized root and/or soil samples and sequenced.

Unlike the DNA profile, an RNA profile varies depending on the environmental conditions. Therefore, sequencing of RNA isolated from colonized roots and/or soil will reflect the transcriptional activity of genes in planta in the rhizosphere.

RNA can be isolated from colonized root and/or soil samples at different time points to analyze the changes in the RNA profile of the colonized microbe at these time points.

For example, RNA can be isolated from colonized root and/or soil samples right after fertilization of the field and a few weeks after fertilization of the field and sequenced to generate corresponding transcriptional profile.

Similarly, RNA sequencing can be carried out under high phosphate and low phosphate conditions to understand which genes are transcriptionally active or repressed under these conditions.

Methods for transcriptomic/RNA sequencing are known in the art. Briefly, total RNA will be isolated from the purified culture of the isolated microbe; cDNA will be prepared using reverse transcriptase; and the cDNA will be sequenced using high throughput sequencing tools described above.

Sequencing reads from the transcriptome analysis can be mapped to the genomic sequence and transcriptional promoters for the genes of interest can be identified.

4. Assay the Plant-Beneficial Activity of Isolated Microbes

The plant-beneficial activity of isolated microbes will be assessed.

For example, nitrogen fixing microbes will be assayed for nitrogen fixation activity using an acetylene reduction assay (ARA) or phosphate solubilizing microbes will be assayed for phosphate solubilization. Any parameter of interest can be utilized and an appropriate assay developed for such. For instance, assays could include growth curves for colonization metrics and assays for production of phytohormones like indole acetic acid (IAA) or gibberellins. An assay for any plant-beneficial activity that is of interest can be developed.

This step will confirm the phenotype of interest and eliminate any false positives.

5. Selection of Potential Candidates from Isolated Microbes

The data generated in the above steps will be used to select microbes for further development. For example, microbes showing a desired combination of colonization potential, plant-beneficial activity, and/or relevant DNA and RNA profile will be selected for domestication and remodeling.

C. Domestication of Selected Microbes

The selected microbes will be domesticated; wherein, the microbes will be converted to a form that is genetically tractable and identifiable.

1. Test for Antibiotic Sensitivity

One way to domesticate the microbes is to engineer them with antibiotic resistance. For this, the wild type microbial strain will be tested for sensitivity to various antibiotics. If the strain is sensitive to the antibiotic, then the antibiotic can be a good candidate for use in genetic tools/vectors for remodeling the strain.

2. Design and Build a Vector

Vectors that are conditional for their replication (e.g. a suicide plasmid) will be constructed to domesticate the selected microbes (host microbes). For example, a suicide plasmid containing an appropriate antibiotic resistance marker, a counter selectable marker, an origin of replication for maintenance in a donor microbe (e.g. *E. coli*), a gene encoding a fluorescent protein (GFP, RFP, YFP, CFP, and the like) to screen for insertion through fluorescence, an origin of transfer for conjugation into the host microbe, and a polynucleotide sequence comprising homology arms to the host genome with a desired genetic variation will be constructed. The vector may comprise a SceI site and other additional elements.

Exemplary antibiotic resistance markers include ampicillin resistance marker, kanamycin resistance marker, tetracycline resistance marker, chloramphenicol resistance marker, erythromycin resistance marker, streptomycin resistance marker, spectinomycin resistance marker, etc. Exemplary counter selectable markers include sacB, rpsL, tetAR, pheS, thyA, lacY, gata-1, ccdB, etc.

3. Generation of Donor Microbes

In one protocol, a suicide plasmid containing an appropriate antibiotic resistance marker, a counter selectable marker, the λpir origin of replication for maintenance in *E. coli* ST18 containing the pir replication initiator gene, a gene encoding green fluorescent protein (GFP) to screen for insertion through fluorescence, an origin of transfer for conjugation into the host microbe, and a polynucleotide sequence comprising homology arms to the host genome with a desired genetic variation (e.g. a promoter from within the microbe's own genome for insertion into a heterologous location) will be transformed into *E. coli* ST18 (an auxotroph for aminolevulinic acid, ALA) to generate donor microbes.

4. Mix Donor Microbes with Host Microbes

Donor microbes will be mixed with host microbes (selected candidate microbes from step B5) to allow conjugative integration of the plasmid into the host genome. The mixture of donor and host microbes will be plated on a medium containing the antibiotic and not containing ALA. The suicide plasmid is able to replicate in donor microbes (*E. coli* ST18), but not in the host. Therefore, when the mixture containing donor and host microbes is plated on a medium containing the antibiotic and not containing ALA, only host cells that integrated the plasmid into its genome will be able to grow and form colonies on the medium. The donor microbes will not grow due to the absence of ALA.

5. Confirm Integration of the Vector

A proper integration of the suicide plasmid containing the fluorescent protein marker, the antibiotic resistance marker, the counter selectable marker, etc. at the intended locus of the host microbe will be confirmed through fluorescence of colonies on the plate and using colony PCR.

6. Streak Confirm Integration Colony

A second round of homologous recombination in the host microbes will loop out (remove) the plasmid backbone leaving the desired genetic variation (e.g. a promoter from within the microbe's own genome for insertion into a heterologous location) integrated into the host genome of a certain percentage of host microbes, while reverting a certain percentage back to wild type.

Colonies of host microbes that have looped out the plasmid backbone (and therefore, looped out the counter selectable marker) can be selected by growing them on an appropriate medium.

For example, if sacB is used as a counter selectable marker, loss of this marker due to the loss of the plasmid backbone will be tested by growing the colonies on a medium containing sucrose (sacB confers sensitivity to sucrose). Colonies that grow on this medium would have lost the sacB marker and the plasmid backbone and would either contain the desired genetic variation or be reverted to wild type. Also, these colonies will not fluoresce on the plate due to the loss of the fluorescent protein marker.

In some isolates, the sacB or other counterselectable markers do not confer full sensitivity to sucrose or other counterselection mechanisms, which necessitates screening large numbers of colonies to isolate a successful loop-out. In those cases, loop-out may be aided by use of a "helper plasmid" that replicates independently in the host cell and expresses a restriction endonuclease, e.g. SceI, which recognizes a site in the integrated suicide plasmid backbone. The strain with the integrated suicide plasmid is transformed with the helper plasmid containing an antibiotic resistance marker, an origin of replication compatible with the host strain, and a gene encoding a restriction endonuclease controlled by a constitutive or inducible promoter. The double-strand break induced in the integrated plasmid backbone by the restriction endonuclease promotes homologous recombination to loop-out the suicide plasmid. This increases the number of looped-out colonies on the counterselection plate and decreases the number of colonies that need to be screened to find a colony containing the desired mutation. The helper plasmid is then removed from the strain by culture and serial passaging in the absence of antibiotic selection for the plasmid. The passaged cultures are streaked for single colonies, colonies are picked and screened for sensitivity to the antibiotic used for selection of the helper plasmid, as well as absence of the plasmid confirmed by colony PCR. Finally, the genome is sequenced and the absence of helper plasmid DNA is confirmed as described in D6.

7. Confirm Integration of the Genetic Variation Through Colony PCR

The colonies that grew better on the sucrose-containing medium (or other appropriate media depending on the counter selectable marked used) will be picked and the presence of the genetic variation at the intended locus will be confirmed by screening the colonies using colony PCR.

Although this example describes one protocol for domesticating the microbe and introducing genetic variation into the microbe, one of ordinary skill in the art would understand that the genetic variation can be introduced into the selected microbes using a variety of other techniques known in the art such as: polymerase chain reaction mutagenesis, oligonucleotide-directed mutagenesis, saturation mutagenesis, fragment shuffling mutagenesis, homologous recombination, ZFN, TALENS, CRISPR systems (Cas9, Cpf1, etc.), chemical mutagenesis, and combinations thereof.

8. Iterate Upon Steps C2-C7

If any of the steps C2-C7 fail to provide the intended outcome, the steps will be repeated to design an alternative vector that may comprise different elements for facilitating incorporation of desired genetic variations and markers into the host microbe.

9. Develop a Standard Operating Procedure (Sop)

Once the steps C2-C7 can be reproduced consistently for a given strain, the steps will be used to develop a standard operating procedure (SOP) for that strain and vector. This SOP can be used to improve other plant-beneficial traits of the microbe.

D. Non-Intergeneric Engineering Campaign and Optimization

1. Identify Gene Targets for Optimization

Selected microbes will be engineered/remodeled to improve performance of the plant-beneficial activity. For this, gene targets for improving the plant-beneficial activity will be identified.

Gene targets can be identified in various ways. For example, genes of interest can be identified while annotating the genes from the whole genome sequencing of isolated microbes. They can be identified through a literature search. For example, genes involved in nitrogen fixation are known in the literature. These known genes can be used as targets for introducing genetic variations. Gene targets can also be identified based on the RNA sequencing data obtained in the step B3 (small-scale field trials for colonization) or by performing RNA sequencing described in the step below.

2. Select Promoters for Promoter Swaps

A desired genetic variation for improving the plant-beneficial activity can comprise promoter swapping, in which the native promoter for a target gene is replaced with a stronger or weaker promoter (when compared to the native promoter) from within the microbe's genome, or differently regulated promoter (e.g. a N-independent). If the expression of a target gene increases the plant-beneficial activity (e.g., nifA, the expression of which enhances nitrogen fixation in microbes), the desired promoter for promoter swapping is a stronger promoter (compared to the native promoter of the target gene) that would further increase the expression level of the target gene compared to the native promoter. If the expression of a target gene decreases the plant-beneficial activity (e.g., nifL that downregulates nitrogen fixation), the desired promoter for promoter swapping is a weak promoter (compared to the native promoter of the target gene) that would substantially decrease the expression level of the target gene compared to the native promoter. Promoters can be inserted into genes to "knock-out" a gene's expression, while at the same time upregulating the expression of a downstream gene.

Promoters for promoter swapping can be selected based on the RNA sequencing data. For example, the RNA sequencing data can be used to identify strong and weak promoters, or constitutively active vs. inducible promoters.

For example, to identify strong and weak promoters, or constitutively active vs. inducible promoters, in the nitrogen fixation pathway, selected microbes will be cultured in vitro under nitrogen-depleted and nitrogen-replete conditions; RNA of the microbe will be isolated from these cultures; and sequenced.

In one protocol, the RNA profile of the microbe under nitrogen-depleted and nitrogen-replete conditions will be compared and active promoters with a desired transcription level will be identified. These promoters can be selected to swap a weak promoter.

Promoters can also be selected using the RNA sequencing data obtained in the step B3 that reflects the RNA profile of the microbe in planta in the host plant rhizosphere.

RNA sequencing under various conditions allows for selection of promoters that: a) are active in the rhizosphere during the host plant growth cycle in fertilized field conditions, and b) are also active in relevant in vitro conditions so they can be rapidly screened.

In an exemplary protocol, in planta RNA sequencing data from colonization assays (e.g. step B3) is used to measure the expression levels of genes in isolated microbes. In one embodiment, the level of gene expression is calculated as reads per kilobase per million mapped reads (RPKM). The expression level of various genes is compared to the expression level of a target gene and at least the top 10, 20, 30, 40, 50, 60, or 70 promoters, associated with the various genes, that show the highest or lowest level of expression compared to the target gene are selected as possible candidates for promoter swapping. Thus, one looks at expression levels of various genes relative to a target gene and then selects genes that demonstrate increased expression relative to a target (or standard) gene and then find the promoters associated with said genes.

For example, if the target gene is upregulation of nifA, the first 10, 20, 30, 40, 50, or 60 promoters for genes that show the highest level of expression compared to nifA are selected as possible candidates for promoter swapping.

These candidates can be further short-listed based on in vitro RNA sequencing data. For example, for nifA as the target gene, possible promoter candidates selected based on the in planta RNA sequencing data are further selected by choosing promoters with similar or increased gene expression levels compared to nifA under in vitro nitrogen-deplete vs. nitrogen-replete conditions.

The set of promoters selected in this step are used to swap the native promoter of the target gene (e.g. nifA). Remodeled strains with swapped promoters are tested in in vitro assays; strains with lower than expected activity are eliminated; and strains with expected or higher than expected activity are tested in field. The cycle of promoter selection may be repeated on remodeled strains to further improve their plant-beneficial activity.

Described here is an exemplary promoter swap experiment that was carried out based on in planta and in vitro RNA sequencing data from *Klebsiella* variicola strain, CI137 to improve the nitrogen fixation trait. CI137 was analyzed in ARA assays at 0 mM and 5 mM glutamine concentration and RNA was extracted from these ARA samples. The RNA was sequenced via NextSeq and a subset of reads from one sample was mapped to the CI137 genome (in vitro RNA sequencing data). RNA was extracted from the roots of corn plants at V5 stage in the colonization and activity assay (e.g. step B3) for CI137. Samples from 6 plants were pooled; the RNA from the pooled sample was sequenced using NextSeq, and reads were mapped to the CI137 genome (in planta RNA sequencing data). Out of $2\times10^8$ total reads, $7\times10^4$ reads mapped to CI137. In planta RNA sequencing data was used to rank genes in order of in planta expression levels and the expression levels were compared to the native nifA expression level. The first 40 promoters that showed the highest expression level (based on gene expression) compared to the native nifA expression level were selected. These 40 promoters were further short-listed based on the in vitro RNA sequencing data, where promoters with increased or similar in vitro expression levels compared to nifA were selected. The final list of promoters included 17 promoters and 2 versions of most promoters were used to generate promoter swap mutants; thus a total of 30 promoters were tested. Generation of a suite of CI137 mutants where nifL was deleted partially or completely and the 30 promoters inserted (ΔnifL::Prm) was attempted. 28 out of 30 mutants were generated successfully. The ΔnifL::Prm mutants were analyzed in ARA assays at 0 mM and 5 mM glutamine concentration and RNA was extracted from these ARA samples. Several mutants showed lower than expected or decreased ARA activity compared to the WT CI137 strain. A few mutants showed higher than expected ARA activity.

A person of ordinary skill in the art would appreciate from the above example that while in planta and/or in vitro RNA sequencing data can be used to select promoters for promoter swapping, the step of promoter selection is highly unpredictable and involves many challenges.

For example, in planta RNA sequencing mainly reveals the genes that are highly expressed; however, it is difficult to detect fine differences in gene expression and/or genes with low expression levels. For instance, in some in planta RNA sequencing experiments, only about 40 out of about 5000 genes from a microbial genome were detected. Thus, in planta RNA sequencing technique is useful to identify abundantly expressed genes and their corresponding promoters; however, the technique has difficulty in identifying low expression genes and corresponding promoters and small differences between gene expression.

Furthermore, in planta RNA profile reflects the status of the genes at the time the microbes were isolated; however, a slight change in the field conditions can substantially change the RNA profile of rhizosphere/epiphyticiendophytic microbes. Therefore, it is difficult to predict in advance whether the promoters selected based on one field trial RNA sequencing data would provide desirable expression levels of the target gene when remodeled strains are tested in vitro and in field.

Additionally, in planta evaluation is time and resource-consuming; therefore, in planta experiments cannot be conducted often and/or repeated quickly or easily. On the other hand, while in vitro RNA sequencing can be conducted relatively quickly and easily, the in vitro conditions do not mimic the field conditions and promoters that may show high activity in vitro may not show comparable activity in planta.

Moreover, promoters often don't behave as predicted in a new context. Therefore, in planta and in vitro RNA sequencing data can at best serve as a starting point in the step of promoter selection; however, arriving at any particular promoter that would provide desirable expression levels of the target gene in the field is, in some instances, unpredictable.

Another limitation in the step of promoter selection is the number of available promoters. Because one of the goals of the present invention is to provide non-transgenic microbes; promoters for promoter swapping need to be selected from within the microbe's genome, or genus. Thus, unlike a transgenic approach, the present process can not merely go out into the literature and find/use a well characterized transgenic promoter from a different host organism.

Another constraint is that the promoter must be active in planta during a desired growth phase. For example, the highest requirement for nitrogen in plants is generally late in the growing season, e.g. late vegetative and early reproductive phases. For example, in corn, nitrogen uptake is the highest during V6 (6 leaves) through R1 (reproductive stage 1) stages. Therefore, to increase the availability of nitrogen during V6 through R1 stages of corn, remodeled microbes must show highest nitrogen fixation activity during these stages of the corn lifecycle. Accordingly, promoters that are active in planta during the late vegetative and early reproductive stages of corn need to be selected. This constraint not only reduces the number of promoters that may be tested in promoter swapping, but also make the step of promoter selection unpredictable. As discussed above, unpredictability arises, in part, because although the RNA sequencing data from small scale field trials (e.g. step B3) may be used to identify promoters that are active in planta during a desired growth stage, the RNA data is based on the field conditions (e.g., type of soil, level of water in the soil, level of available nitrogen, etc.) at the time of sample collection. As one of ordinary skill in the art would understand, the field conditions may change over the period of time within the same field and also change substantially across various fields. Thus, the promoters selected under one field condition may not behave as expected under other field conditions. Similarly, selected promoters may not behave as expected after swapping. Therefore, it is difficult to anticipate in advance whether the selected promoters would be active in planta during a desired growth phase of a plant of interest.

3. Design Non-Intergeneric Genetic Variations

Based on steps D1 (identification of gene targets) and D2 (identification of promoters for promoter swaps), non-intergeneric genetic variations will be designed.

The term "non-intergeneric" indicates that the genetic variation to be introduced into the host does not contain a nucleic acid sequence from outside the host genus (i.e., no transgenic DNA). Although vectors and/or other genetic tools will be used to introduce the genetic variation into the host microbe, the methods of the present disclosure include steps to loop-out (remove) the backbone vector sequences or other genetic tools introduced into the host microbe leaving only the desired genetic variation into the host genome. Thus, the resulting microbe is non-transgenic.

Exemplary non-intergeneric genetic variations include a mutation in the gene of interest that may improve the function of the protein encoded by the gene; a constitutionally active promoter that can replace the endogenous promoter of the gene of interest to increase the expression of the gene; a mutation that will inactivate the gene of interest; the insertion of a promoter from within the host's genome into a heterologous location, e.g. insertion of the promoter into a gene that results in inactivation of said gene and upregulation of a downstream gene; and the like. The mutations can be point mutations, insertions, and/or deletions (full or partial deletion of the gene). For example, in one protocol, to improve the nitrogen fixation activity of the host microbe, a desired genetic variation may comprise an inactivating mutation of the nifL gene (negative regulator of nitrogen fixation pathway) and/or comprise replacing the endogenous promoter of the nifH gene (nitrogenase iron protein that catalyzes a key reaction to fix atmospheric nitrogen) with a constitutionally active promoter that will drive the expression of the nifH gene constitutively.

4. Generate Non-Intergeneric Derivative Strains

After designing the non-intergeneric genetic variations, steps C2-C7 will be carried out to generate non-intergeneric derivative strains (i.e. remodeled microbes).

5. Bank a Purified Culture of the Remodeled Microbe

A purified culture of the remodeled microbe will be preserved in a bank, so that gDNA can be extracted for whole genome sequencing described below.

6. Confirm Presence of the Desired Genetic Variation

The genomic DNA of the remodeled microbe will be extracted and the whole genome sequencing will be performed on the genomic DNA using methods described previously. The resulting reads will be mapped to the reads previously stored in LIMS to confirm: a) presence of the desired genetic variation, and b) complete absence of reads mapping to vector sequences (e.g. plasmid backbone or helper plasmid sequence) that were used to generate the remodeled microbe.

This step allows sensitive detection of non-host genus DNA (transgenic DNA) that may remain in the strain after looping out of the vector backbone (e.g. suicide plasmid) method and could provide a control for accidental off-target insertion of the genetic variation, etc.

E. Analytics Upon Remodeled Microbes

1. Analysis of the Plant-Beneficial Activity

The plant-beneficial activity and growth kinetics of the remodeled microbes will be assessed in vitro.

For example, strains remodeled for improving nitrogen fixation function will be assessed for nitrogen fixation activity and fitness through acetylene reduction assays, ammonium excretion assays, etc.

Strains remodeled for improved phosphate solubilization will be assessed for the phosphate solubilization activity.

This step allows rapid, medium to high throughput screening of remodeled strains for the phenotypes of interest.

2. Analysis of Colonization and Transcription of the Altered Genes

Remodeled strains will be assessed for colonization of the host plant either in the greenhouse or in the field using the steps described in B3. Additionally, RNA will be isolated from colonized root and/or soil samples and sequenced to analyze the transcriptional activity of target genes. Target genes comprise the genes containing the genetic variation introduced and may also comprise other genes that play a role in the plant-beneficial trait of the microbe.

For example, a cluster of genes, the nif genes, controls the nitrogen fixation activity of microbes. Using the protocol described above, a genetic variation may be introduced into one of the nif genes (e.g. a promoter insertion), whereas the other genes in the nif cluster are in their endogenous form (i.e. their gene sequence and/or the promoter region is not altered). The RNA sequencing data will be analyzed for the transcriptional activity of the nif gene containing the genetic variation and may also be analyzed for other nif genes that are not altered directly, by the inserted genetic change, but nonetheless may be influenced by the introduced genetic change.

This step allows determination of the fitness of top in vitro performing strains in the rhizosphere and allows measurement of the transcriptional activity of altered genes in planta.

F. Iterate Engineering Campaign/Analytics

The data from in vitro and in planta analytics (steps E1 and E2) will be used to iteratively stack beneficial mutations.

Furthermore, steps A-E described above may be repeated to fine tune the plant-beneficial traits of the microbes. For example, plants will be inoculated using microbial strains remodeled in the first round; harvested after a few weeks of growth; and microbes from the soil and/or roots of the plants will be isolated. The functional activity (plant-beneficial trait and colonization potential) and the DNA and RNA profile of isolated microbes will be characterized, in order to select microbes with improved plant-beneficial activity and colonization potential. The selected microbes will be remodeled to further improve the plant-beneficial activity. Remodeled microbes will be screened for the functional activity (plant-beneficial trait and colonization potential) and RNA profile in vitro and in p/anta and the top performing strains will be selected. If desired, steps A-E can be repeated to further improve the plant-beneficial activity of the remodeled microbes from the second round. The process can be repeated for 1, 2, 3, 4, 5, 6, 7, 8, 9, 10, or more rounds.

The exemplary steps described above are summarized in Table A below. PGP-47,T1,M

TABLE A

An Overview of an Embodiment of the Guided Microbial Remodeling Platform

| | Steps | Contribution | Alternate Forms |
|---|---|---|---|
| A | Isolation | | |
| 1 | Obtain a soil sample | Provides WT soil microbes to be isolated | |
| 2 | Grow corn "bait plants" in soil sample | Allows selection of plant-beneficial microbes by rhizosphere | Wheat, sorghum, rice, millet, soybean, etc. |
| 3 | Harvest, clean and extract root sample and plate on nitrogen-free (specifically NfB) media | Down-select soil microbes to those that a) colonize the root and b) fix atmospheric nitrogen | Other nitrogen-free media, other selective or screening media (e.g. for phosphate solubilization) |
| 4 | Pick colonies, purify cultures and screen for presence of nifH using degenerate primers<br>Bank a purified culture of the strain | Down-select microbes to those containing the nifH gene (eliminate false-positives from media screen) | Degenerate primers for other genes of interest, e.g. ipdC (phytohormone biosynthesis) |
| B | Characterization | | |
| 1 | Sequence and assemble the genome of the strain using Illumina and/or PacBio platform | Characterize genome for key pathways | |
| 2 | Assay the microbe for colonization of corn roots in the greenhouse (qPCR-based method) | Down-select for microbes that colonize the plant well | Wheat, sorghum, rice, millet, soybean, etc., other methods for assaying colonization (e.g. plating) |
| 3 | Assay the microbe for colonization of corn roots in a small-scale field trials (qPCR-based method) and isolate RNA from colonized root samples | Known internally as "CAT" trials, these provide Colonization And Transcript data for the strain in a field environment | Larger field trials, other crops, other methods for assaying colonization (e.g. plating) |
| 4 | Assay the microbe for nitrogen fixation activity in an acetylene reduction assay (ARA) | Confirm N-fixation phenotype of strain | |

TABLE A-continued

| An Overview of an Embodiment of the Guided Microbial Remodeling Platform | | | |
|---|---|---|---|
| | Steps | Contribution | Alternate Forms |
| 5 | Use the above data to select candidate microbe for further domestication and optimization | Allows selection of greatest-potential candidates | |
| C | Domestication | | |
| 1 | Test microbes for sensitivity to various antibiotics | Determine which antibiotic selection markers can be used to transform genetic tools | |
| 2 | Design and build a suicide plasmid containing an appropriate antibiotic resistance marker, sacB counter-selectable marker, origin of replication for maintenance in *E. coli*, GFP to screen for insertion through fluorescence, origin of transfer for conjugation into the host, homology arms to the host genome, and the desired mutation. | These are the "parts" necessary to maintain the plasmid and carry out conjugation, insertion and "loop-out" of the host genome | Plasmid could contain a SceI site or other counter-selectable marker, alternate fluorescent reporters, additional elements |
| 3 | Transform suicide plasmid into *E. coli* ST18 (an auxotroph for aminolevulinic acid, ALA) to generate donor cells | Preparation for conjugation into host; plasmid maintenance | Could use a different donor strain of *E. coli* or other microbe; different auxotrophic marker |
| 4 | Mix donor cells with recipient host cells to conjugate, and plate on media selecting for the antibiotic resistance marker and NOT containing ALA | The suicide plasmid is able to replicate in *E. coli* but not in the host. Therefore plating of the mixture on such plates means that only host cells that received the plasmid and experience plasmid integration into the chromosome will be able to grow and form colonies. The *E coli* ST18 is unable to grow due to the absence of ALA. | Could use a different donor strain of *E. coli* or other microbe; different auxotrophic marker |
| 5 | Confirm integration of the plasmid through GFP fluorescence, and integration at the intended locus through colony PCR | Confirms proper integration of the suicide plasmid backbone containing GFP, the antibiotic resistance cassette, the sacB marker, etc. | |
| 6 | Streak confirmed integration colony on a plate containing sucrose and screen for non-fluorescent colonies | The sacB marker confers sensitivity to sucrose; colonies which have undergone a second round of homologous recombination and "looped-out" the plasmid will grow better and not fluoresce on the plate. | Different counter selectable marker, SceI-mediated loop-out, etc. |
| 7 | Screen looped-out colonies for the intended mutation using colony PCR | Upon the second homologous recombination event only 50% of looped out colonies should contain the mutation, the other 50% will be WT | |
| 8 | If any of the steps 2-7 fail, go back to step 2 and re-design with alternate plasmid parts | Allows iterative troubleshooting of suicide plasmid to develop a working protocol | |

TABLE A-continued

An Overview of an Embodiment of the Guided Microbial Remodeling Platform

| | Steps | Contribution | Alternate Forms |
|---|---|---|---|
| 9 | Once steps 2-7 can be reliably performed, develop an SOP for that strain/plasmid to be used for Optimization | | |
| D | Non-Intergeneric Engineering Campaign and Optimization | | |
| 1 | Identify gene targets for optimizing a pathway, e.g. nif genes through literature search | | |
| 2 | Select promoters for promoter swaps using RNAseq data collected both in vitro in N-depleted and N-replete conditions, and in planta from the corn rhizosphere (Collected in step B3) | Allows for selection of promoters that a) are active in the rhizosphere during the corn growth cycle in fertilized field conditions b) are also active in in vitro N-replete conditions so they can be rapidly screened. | Alternate crops; alternate RNAseq data conditions (greenhouse, field, in vitro, whatever's relevant for the phenotype targeted) |
| 3 | Design non-intergeneric mutations in key genes: deletions (full or partial gene), promoter swaps, or single base pair changes; store these designs in our LIMS | No DNA from outside the host chromosome is added, therefore the resulting microbe is non-transgenic | Alter regulatory sequences (e.g. RBS), non-coding RNAs, etc. |
| 4 | Using the established protocol, carry out steps C2-7 to generate non-intergeneric derivative strains (mutants) | We perform this in higher throughput than the domestication step - up to 20 or so strains at once per person. | |
| 5 | Bank a purified culture of the strain, extract gDNA and conduct WGS via Illumina | | |
| 6 | Map the resulting reads to the designs stored in LIMS to confirm a) presence of the desire mutation and b) complete absence of reads mapping to any suicide plasmid or other plasmid sequences used to generate the strains | Allows very sensitive detection of non-intergeneric DNA that may remain in the strain after the suicide plasmid method; confirm absence of transgenic DNA, controls for accidental off-target insertion of the suicide plasmid, etc. | Suicide plasmid removal is fairly reliable; however use of other stable plasmids in alternate methods necessitates this extra step to ensure with complete confidence that no transgenic DNA that was previously transformed in remains in the strain. |
| E | Analytics | | |
| 1 | Analyze the strains for in vitro nitrogen fixation activity and fitness through ARA, ammonium excretion assays, and growth curves | Allow rapid, med- to high-throughput screening of mutants for phenotypes of interest | Any other in vitro assay, e.g. phosphate solubilization, qPCR for transcription of specific genes, etc. |
| 2 | Analyze the strains for colonization (qPCR) and transcription of target and promoter-swapped genes (Nanostring) in the plant (greenhouse or field) | Measure fitness of top in vitro performing strains in the rhizosphere; measure transcription of promoter-swapped genes in planta | |

TABLE A-continued

An Overview of an Embodiment of the Guided Microbial Remodeling Platform

| | Steps | Contribution | Alternate Forms |
|---|---|---|---|
| F | Iterate Engineering Campaign/Analytics | | |
| 1 | Use data from in vitro and in planta analytics to iteratively stack beneficial mutations. | | |

Traditional Approaches to Creating Biologicals for Agriculture Suffer From Drawbacks Inherent in their Methodology Unlike pure bioprospecting of wild-type (WT) microbes or transgenic approaches, GMR allows for non-intergeneric genetic optimization of key regulatory networks within the microbe, which improves plant-beneficial phenotypes over WT microbes, but doesn't have the risks associated with transgenic approaches (e.g. unpredictable gene function, public and regulatory concerns). See, FIG. 1C for a depiction of a problematic "traditional bioprospecting" approach, which has several drawbacks compared to the taught GMR platform.

Other methods for developing microbials for agriculture are focused on either extensive lab development, which often fails at the field scale, or extensive greenhouse or "field-first" testing without an understanding of the underlying mechanisms/plant-microbe interactions. See, FIG. 1D for a depiction of a problematic "field-first approach to bioprospecting" system, which has several drawbacks compared to the taught GMR platform.

The GMR Platform Solves these Problems in Numerous Ways

One strength of the GMR platform is the identification of active promoters, which are active at key physiologically important times for a target crop, and which are also active under particular, agriculturally relevant, environmental conditions.

As has been explained, within the context of nitrogen fixation, the GMR platform is able to identify microbial promoter sequences, which are active under environmental conditions of elevated exogenous nitrogen, which thereby allows the remodeled microbe to fix atmospheric nitrogen and deliver it to a target crop plant, under modern agricultural row crop conditions, and at a time when a plant needs the fixed nitrogen the most. See, FIG. 1E for a depiction of the time period in the corn growth cycle, at which nitrogen is needed most by the plant. The taught GMR platform is able to create remodeled microbes that supply nitrogen to a corn plant at the time period in which the nitrogen is needed, and also deliver such nitrogen even in the presence of exogenous nitrogen in the soil environment.

These promoters can be identified by rhizosphere RNA sequencing and read mapping to the microbe's genome sequence, and key pathways can be "reprogrammed" to be turned on or off during key stages of the plant growth cycle. Additionally, through whole genome sequencing of optimized microbes and mapping to previously-transformed sequences, the method has the ability to ensure that no transgenic sequences are accidentally released into the field through off-target insertion of plasmid DNA, low-level retention of plasmids not detected through PCR or antibiotic resistance, etc.

The GMR platform combines these approaches by evaluating microbes iteratively in the lab and plant environment, leading to microbes that are robust in greenhouse and field conditions rather than just in lab conditions.

Various aspects and embodiments of the taught GMR platform can be found in FIGS. 1F-1I. The GMR platform culiminates in the derivation/creation/production of remodeled microbes that possess a plant-beneficial property, e.g. nitrogen fixation.

The traditional bioprospecting methods are not able to produce microbes having the aforementioned properties.

Properties of a Microbe Remodeled for Nitrogen Fixation

Figure 1J:
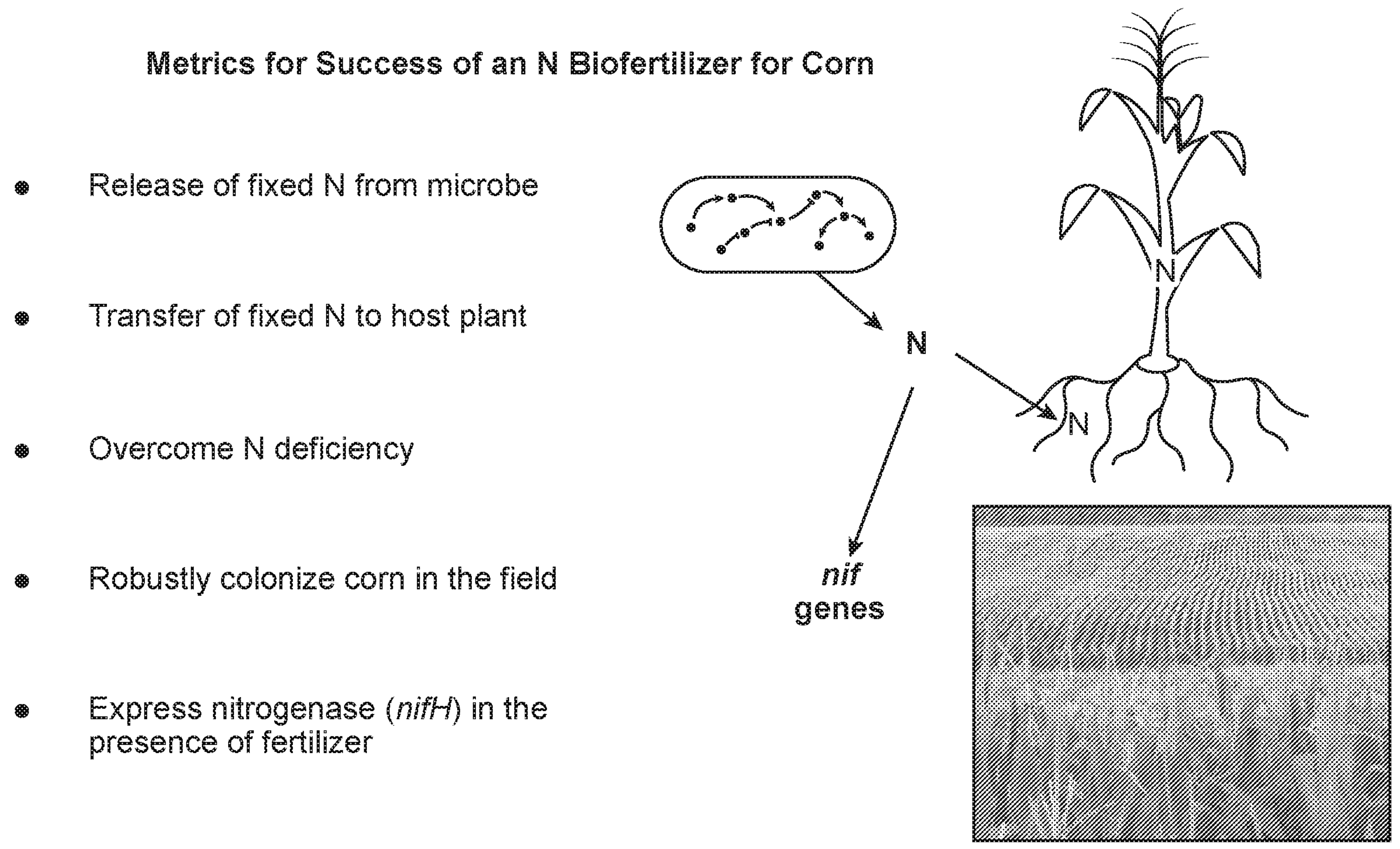
FIG. 1J depicts 5 properties that can be possessed by remodeled microbes of the present disclosure.
Figure 1K:
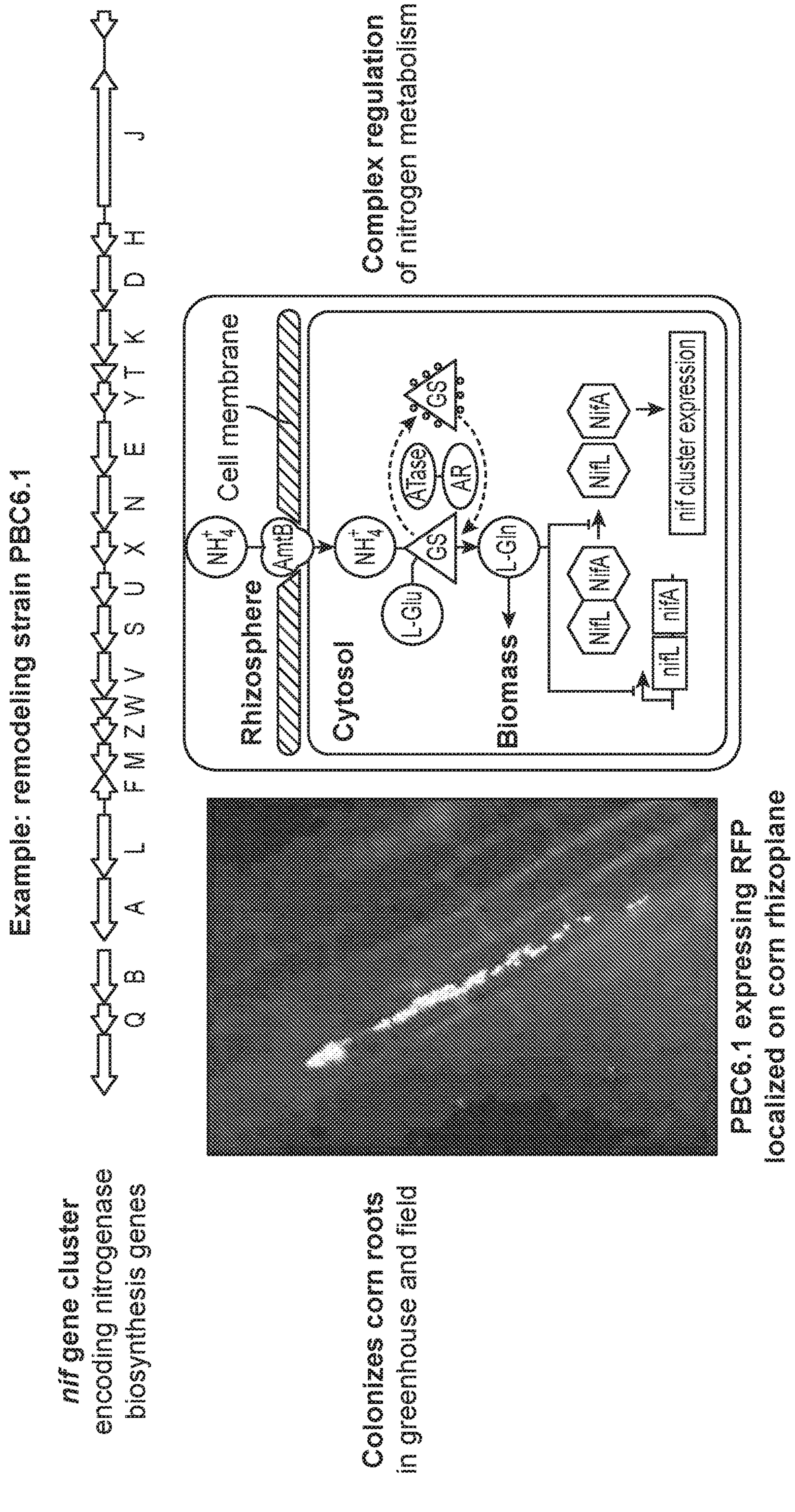
FIG. 1K depicts a schematic of a remodeling approach for a microbe, PBC6.1.
Figure 1L:
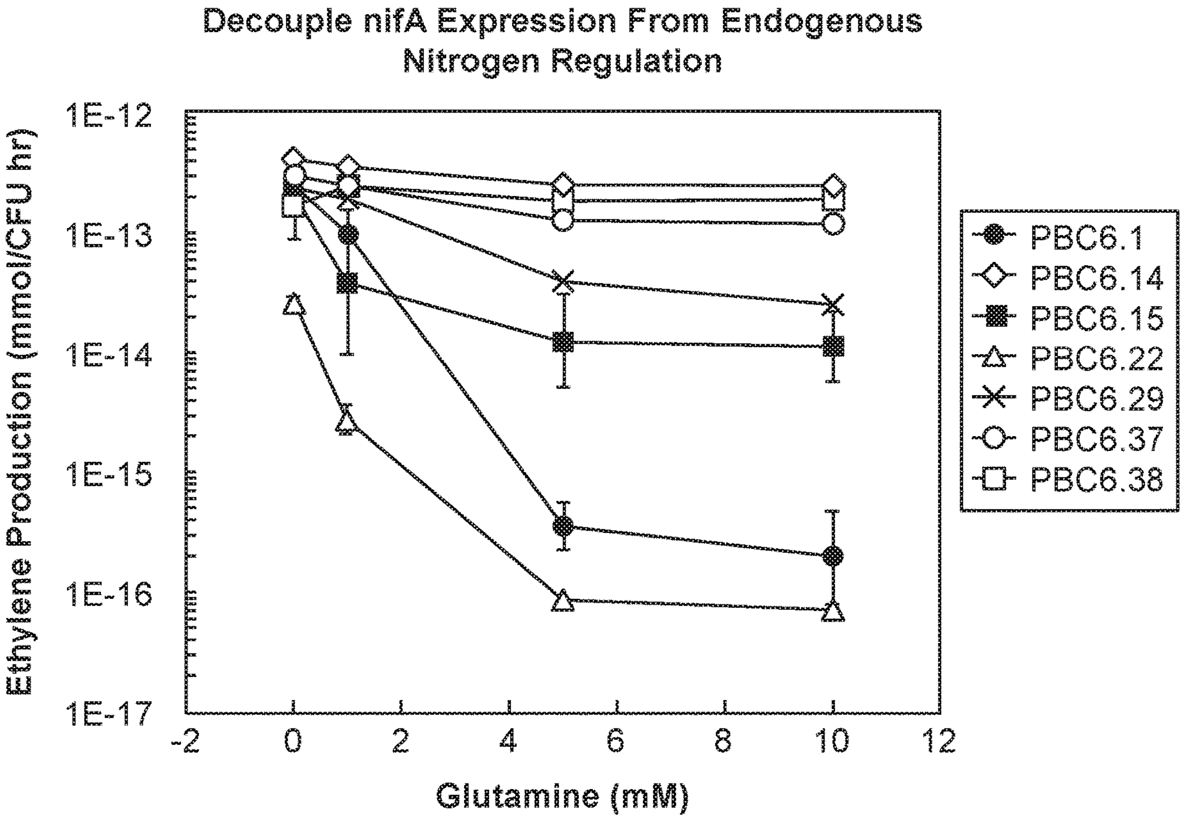
FIG. 1L depicts decoupled nifA expression from endogenous nitrogen regulation in remodeled microbes.
Figure 1M:
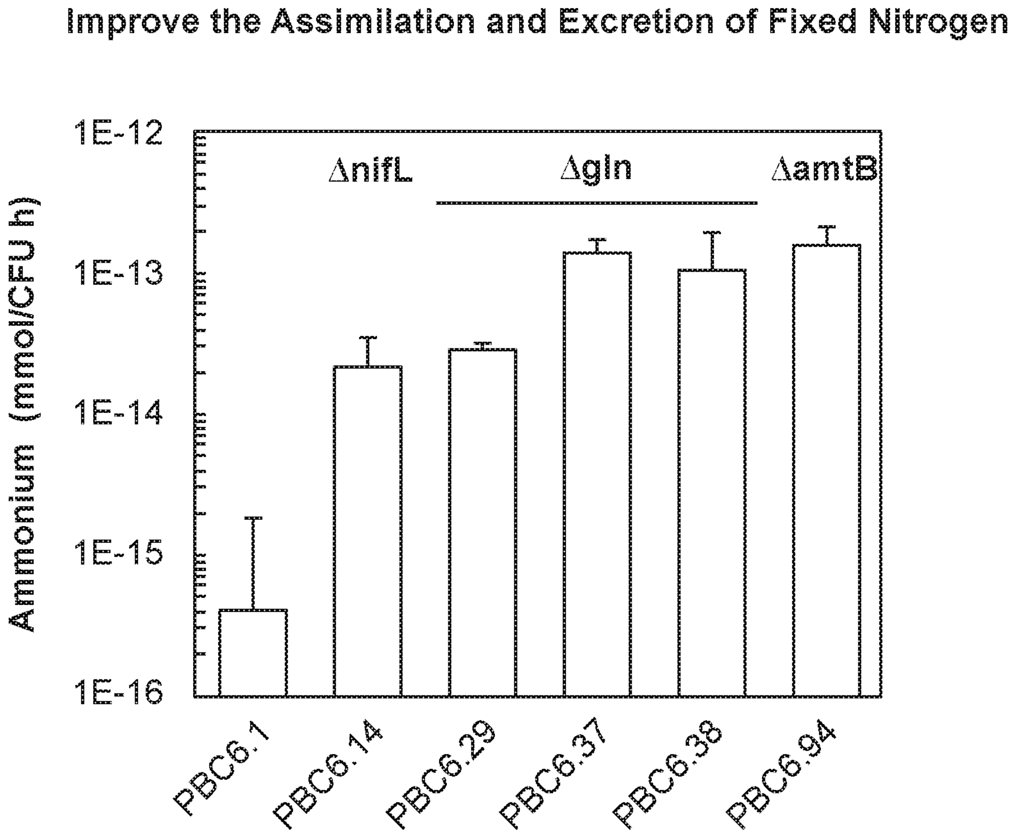
FIG. 1M depicts improved assimilation and excretion of fixed nitrogen by remodeled microbes.
Figure 1N:
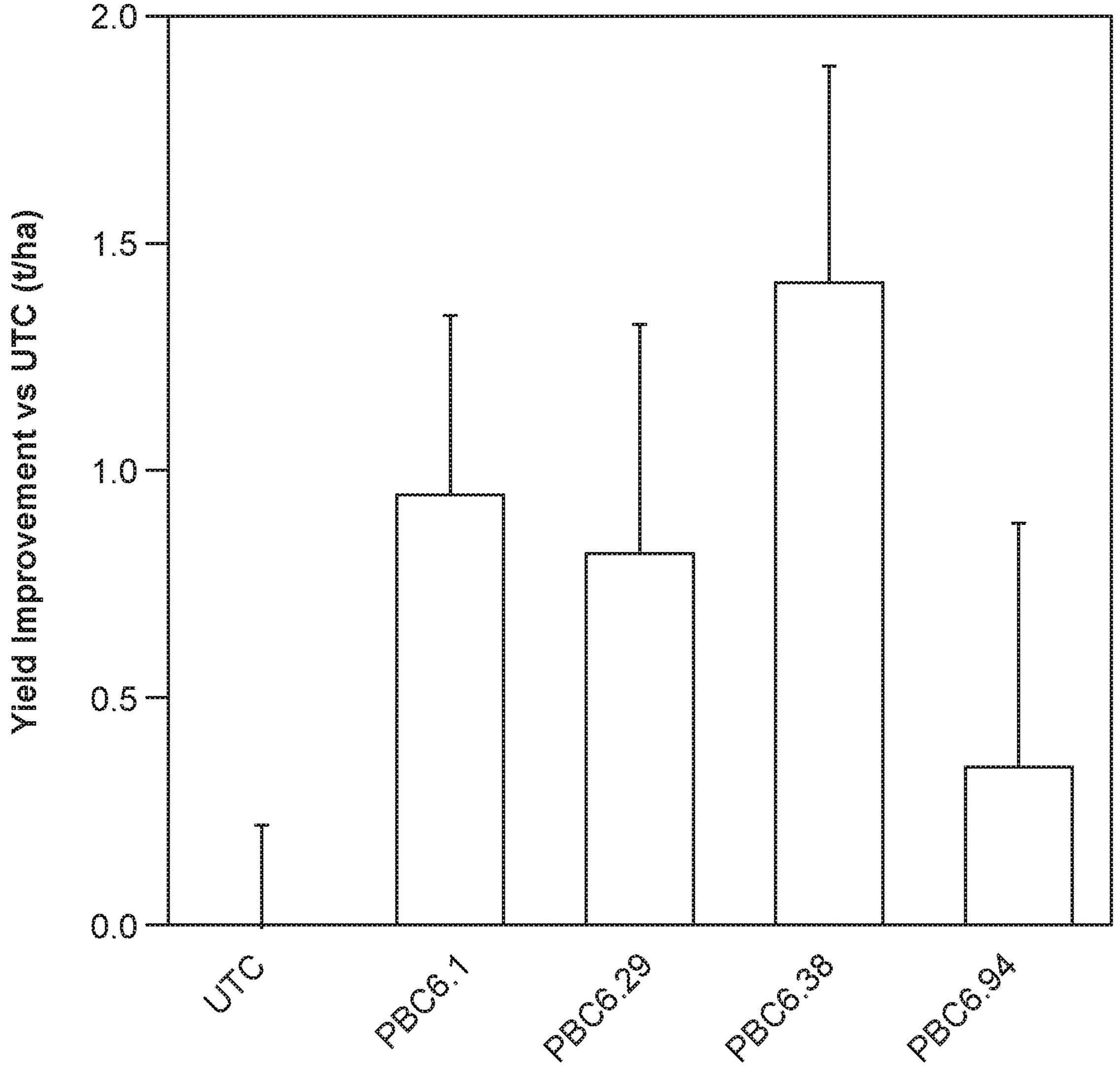
FIG. 1N depicts corn yield improvement attributable to remodeled microbes.

In the context of remodeling microbes for nitrogen fixation, there are several properties that the remodeled microbe may possess. For instance, FIG. 1J depicts 5 properties that can be possessed by remodeled microbes of the present disclosure.

The present inventors have utilized the GMR platform to produce remodeled non-intergeneric bacteria (i.e. Kosakonia *sacchari*) capable of fixing atmospheric nitrogen and delivering said nitrogen to a corn plant, even under conditions in which exogenous nitrogen is present in the environment. See, FIG. 1K-M, which illustrate that the remodeling process successfully: (1) decoupled nifA expression from endogenous nitrogen regulation; and (2) improved the assimilation and excretion of fixed nitrogen.

These remodeled microbes ultimately result in corn yield improvement, when applied to corn crops. See, FIG. 1N.

Figure 1O:
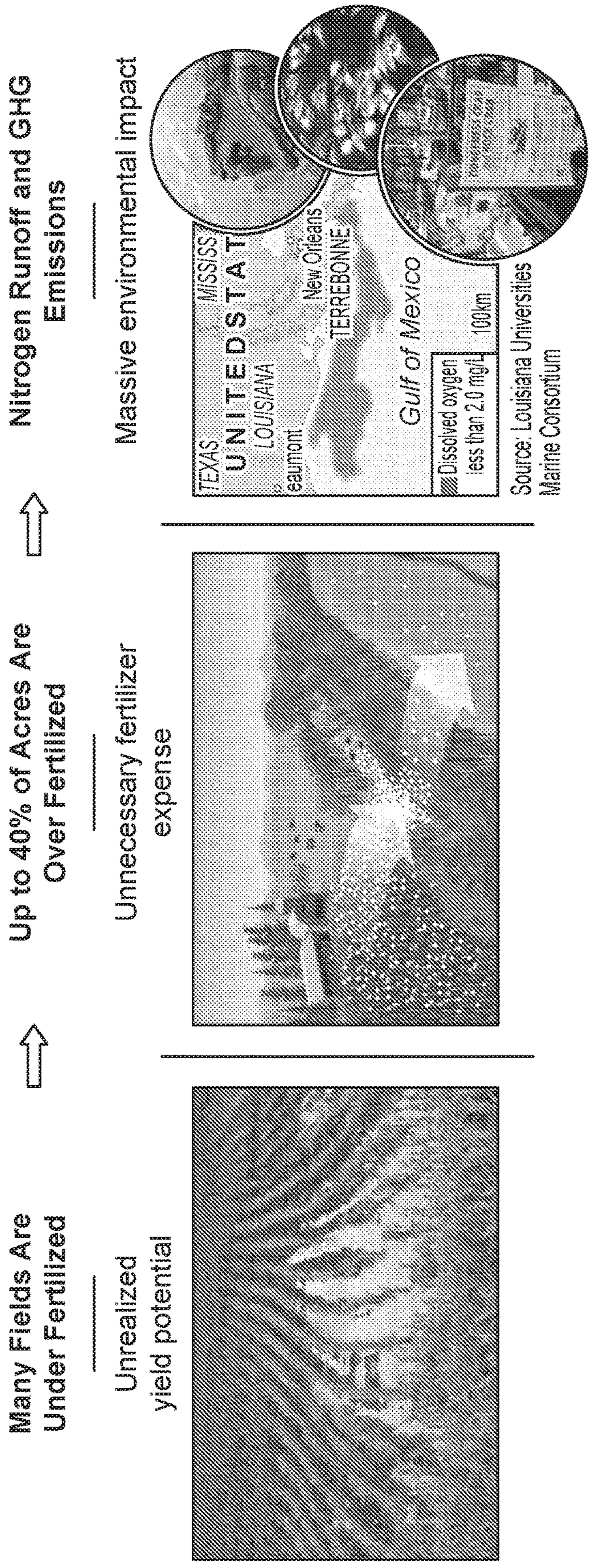
FIG. 1O illustrates the inefficiency of current nitrogen delivery systems, which result in under fertilized fields, over fertilized fields, and environmentally deleterious nitrogen runoff.

The GMR Platform Provides an Approach to Nitrogen Fixation and Delivery that Solves Pressing Environmental Concerns As explained previously, the nitrogen fertilizer produced by the industrial Haber-Bosch process is not well utilized by the target crop. Rain, runoff, heat, volatilization, and the soil microbiome degrade the applied chemical fertilizer. This equates to not only wasted money, but also adds to increased pollution instead of harvested yield. To this end, the United Nations has calculated that nearly 80% of fertilizer is lost before a crop can utilize it. Consequently, modern agricultural fertilizer production and delivery is not only deleterious to the environment, but it is extremely inefficient. See, FIG. 1O, illustrating the inefficiency of current nitrogen delivery systems, which result in under fertilized fields, over fertilized fields, and environmentally deleterious nitrogen runoff.

The current GMR platform, and resulting remodeled microbes, provide a better approach to nitrogen fixation and delivery to plants. As will be seen in the below Examples, the non-intergeneric remodeled microbes of the disclosure are able to colonize the roots of a corn plant and spoon feed said corn plants with fixed atmospheric nitrogen, even in the presence of exogenous nitrogen. This system of nitrogen fixation and delivery-enabled by the taught GMR platform-will help transform modern agricultural to a more environmentally sustainable system.

Example 2: Adoptive Biofilm Transfer—Conferring the Protective Capacity of Biofilms from One Species to Another by Mixing Biofilm with Desired Microbe Some strains of nitrogen fixing bacteria do not create biofilms, and changing the fermentation conditions to force the strain to create a biofilm may have a negative impact on the robustness and titer of the strain.

A biofilm was used as a protective agent during liquid storage or dry storage of the bacteria, *Klebsiella* variicola. The bacterium Kosakonia *sacchari* is a biofilm former and also exhibits a degree of nitrogen fixation. *K. sacchari* was grown in a growth medium while shaking to produce a biofilm, which was isolated by filtration to collect the resulting microbial biofilm composition and subjected to one or more washes to remove effluent and loosely-attached *K. sacchari* cells. The biofilm was then subjected to a heat shock sufficient to kill any remaining *K. sacchari.*

Liquid Storage of Microbes

The heat-shocked biofilm composition was then added to an isolated culture of *Klebsiella* variicola at a 1:1 ratio. The biofilm-containing *Klebsiella* variicola culture and a control *Klebsiella* variicola culture were aliquoted into multiple sealed vials, stored at ambient temperature, and evaluated for colony forming units at day 0, day 21, and day 190.

At day 21, the control *Klebsiella* variicola culture which lacks the *K. sacchari* biofilm exhibited a log loss of 1.09. On the same day, the biofilm-containing *Klebsiella* (trriicola culture exhibited a log loss of 1.08. The biofilm-containing *Klebsiella* variicola culture exhibited an increased viability at day 21 as compared to the control lacking the biofilm.

Solid Storage (on Seed) of Microbes

The heat-shocked biofilm composition was then added to an isolated culture of *Klebsiella variicola* at 10% by volume. The biofilm-containing *Klebsiella variicola* culture and a control *Klebsiella variicola* culture were coated onto corn seed and allowed to dry and stored at a variable temperature (temperature in flux during storage period). The seed coats were evaluated for colony forming units at day 0, day 2, and day 21.

At day 2, the control *Klebsiella variicola* seed coat which lacks the *K. sacchari* biofilm exhibited a log loss of 2.2. On the same day, the experimental biofilm-containing *Klebsiella variicola* seed coat exhibited a log loss of 1.4. At day 21, the control *Klebsiella variicola* seed coat which lacks the *K. sacchari* biofilm exhibited a log loss of 3.3. On the same day, the experimental biofilm-containing *Klebsiella variicola* seed coat exhibited a log loss of 2.7. At both days 2 and 21, the biofilm-containing *Klebsiella variicola* seed coat exhibited an increased viability as compared to the control lacking the biofilm.

Example 3: Adoptive Biofilm Transfer—Conferring the Protective Capacity of Biofilms from One Species to Another by Mixing Biofilm with Desired Microbe Inoculant A biofilm is used as a protective agent during liquid storage or dry storage of the bacteria, *Klebsiella variicola*. The bacterium *Kosakonia sacchari* is a biofilm former and also exhibits a degree of nitrogen fixation. *K. sacchari* is grown in a growth medium while shaking to produce a biofilm, which is then isolated by filtration to collect the resulting microbial biofilm composition and subjected to one or more washes to remove effluent and loosely-attached *K. sacchari* cells. The biofilm is then subjected to a heat shock sufficient to kill any remaining *K. sacchari.*

The heat-shocked biofilm composition is added to media (10% by volume) sufficient to sustain growth of an inoculated culture of *Klebsiella variicola*. The *Klebsiella variicola* culture comprising the biofilm composition is grown to confluence. The biofilm-containing *Klebsiella variicola* culture and a control *Klebsiella variicola* culture are aliquoted into multiple sealed vials, stored at ambient temperature, and evaluated for colony forming units at day 0, day 21, and day 190.

Liquid Storage of Microbes

The biofilm-containing *Klebsiella* variicola culture and a control *Klebsiella* variicola culture are aliquoted into multiple sealed vials, stored at ambient temperature, and evaluated for colony forming units at day 0, day 21, and day 190.

The biofilm-containing *Klebsiella variicola* culture exhibits a greater viability at day 21 and day 190 as compared to the corresponding controls lacking the biofilm.

Solid Storage (on Seed) of Microbes

The biofilm-containing *Klebsiella variicola* culture and a control *Klebsiella variicola* culture are coated onto corn seed and allowed to dry and are stored at a variable temperature (temperature in flux during storage period). The seed coats are evaluated for colony forming units at day 0, day 2, day 21, and day 190.

The biofilm-containing *Klebsiella* variicola culture exhibits a greater viability at day 2, day 21, and day 190 as compared to the corresponding controls lacking the biofilm.

Example 4: Biofilm Protection—Conferring the Protective Capacity of Biofilms from One Species to Another by Co-Inoculation of a Biofilm Producer and a Non-Producer A biofilm is used as a protective agent during liquid storage or dry storage of the bacteria, *Klebsiella variicola*. The bacterium *Kosakonia sacchari* is a biofilm former and also exhibits a degree of nitrogen fixation. *K. sacchari* and *Klebsiella variicola* are co-inoculated into a growth medium capable of supporting the growth of both bacteria. The resulting culture is a one that comprises both *K. sacchari* and *Klebsiella variicola* in contact with the biofilm produced by *K. sacchari*. The microbial composition is purified to remove spent media.

Liquid Storage of Microbes

The biofilm-containing *K. sacchari* and *Klebsiella* variicola co-culture and a control *Klebsiella* variicola culture are aliquoted into multiple sealed vials, stored at ambient temperature, and evaluated for colony forming units of *Klebsiella* variicola at day 0, day 21, and day 190.

The biofilm-containing *K. sacchari* and *Klebsiella variicola* co-culture exhibits a greater viability for *Klebsiella variicola* at day 21 and day 190 as compared to the corresponding controls lacking the biofilm.

Solid Storage (on Seed) of Microbes

The biofilm-containing *K. sacchari* and *Klebsiella variicola* co-culture and a control *Klebsiella variicola* culture are coated onto corn seed and allowed to dry and are stored at a variable temperature (temperature in flux during storage period). The seed coats are evaluated for colony forming units of *Klebsiella variicola* at day 0, day 2, day 21, and day 190.

The biofilm-containing *K. sacchari* and *Klebsiella variicola* co-culture exhibits a greater viability for *Klebsiella variicola* at day 2, day 21, and day 190 as compared to the corresponding controls lacking the biofilm.

Example 5: In-Jug Stability of Compositions Comprising One or More Isolated Bacteria and a Biofilm Produced by One or More Microbes Biofilm was produced by growing *K. sacchari* under biofilm forming condition as described in Example 3. The biofilm was then subjected to a heat shock to remove all viable *K. sacchari* cells. Biofilm was used at three different concentrations to formulate fermentation broth for two remodeled strains of *Klebsiella variicola:* 137-1036 and 137-1034.

Formulated samples were stored at 25° C. and 37° C. and viability was measured at T=0, T=1 week and T=2 weeks.

The remodeled strains responded to biofilm differently at 25° C. and at a high temperature (37° C.). At 37° C., both strains showed significant stability improvement at 1 week and 2 weeks when the biofilm was in the formulation compared to control formulation (FIGS. 2B, 3B, 4B, and 5B).

At 25° C., 137-1036 showed improved stability at 2 weeks storage for the biofilm-containing formulation (FIG. 3A) whereas at 1 week, the stability was similar for the biofilm-containing formulation and the control formulation (FIG. 2A).

At 25° C., 137-1034 showed variations in stability (FIGS. 4A and 5A) whereas it showed consistently improved stability at 37° C. (FIGS. 4B and 5B).

Taken together, the data demonstrates that the addition of biofilm reduced the loss in viability during 2 weeks storage of both strains at high temperature compared to control (non-formulated strains). Also, the improvement in viability was directly proportional to the concentration of the biofilm, i.e., at higher concentrations of biofilm, there was a less loss in viability (formulations were more stable at higher concentrations of biofilm).

Table 25 and Table 26 describe microbes, their underlying genetic architecture, and their corresponding SEQ ID NOs. These microbes have been derived utilizing the GMR platform described in Example 1. It is contemplated that these microbes may be contained in a biofilm formulation as described herein.

TABLE 25

WT and Remodeled Non-intergeneric Microbes

| Strain Name | Genotype | SEQ ID NO |
|---|---|---|
| CI006 | 16S rDNA - contig 5 | 62 |
| CI006 | 16S rDNA - contig 8 | 63 |
| CI019 | 16S rDNA | 64 |
| CI006 | nifH | 65 |
| CI006 | nifD | 66 |
| CI006 | nifK | 67 |
| CI006 | nifL | 68 |
| CI006 | nifA | 69 |
| CI019 | nifH | 70 |
| CI019 | nifD | 71 |
| CI019 | nifK | 72 |
| CI019 | nifL | 73 |
| CI019 | nifA | 74 |
| CI006 | Prm5 with 500 bp flanking regions | 75 |
| CI006 | nifLA operon - upstream intergenic region plus nifL and nifA CDSs | 76 |
| CI006 | nifL (Amino Acid) | 77 |
| CI006 | nifA (Amino Acid) | 78 |
| CI006 | glnE | 79 |
| CI006 | glnE_KO1 | 80 |
| CI006 | glnE (Amino Acid) | 81 |
| CI006 | glnE_KO1 (Ammo Acid) | 82 |
| CI006 | GlnE ATase domain (Amino Acid) | 83 |
| CM029 | Prm5 inserted into nifL region | 84 |

TABLE 26

WT and Remodeled Non-intergeneric Microbes

| Strain | Strain ID | SEQ ID NO | Genotype | Description | Associated Novel Junction If Applicable |
|---|---|---|---|---|---|
| CI63; CI063 | 63 | SEQ ID NO 85 | 16S | N/A | N/A |
| CI63; CI063 | 63 | SEQ ID NO 86 | nifH | N/A | N/A |
| CI63; CI063 | 63 | SEQ ID NO 87 | nifD1 | 1 of 2 unique genes annotated as nifD in 63 genome | N/A |
| CI63; CI063 | 63 | SEQ ID NO 88 | nifD2 | 2 of 2 unique genes annotated as nifD in 63 genome | N/A |
| CI63; CI063 | 63 | SEQ ID NO 89 | nifK1 | 1 of 2 unique genes annotated as nifK in 63 genome | N/A |
| CI63; CI063 | 63 | SEQ ID NO 90 | nifK2 | 2 of 2 unique genes annotated as nifK in 63 genome | N/A |
| CI63; CI063 | 63 | SEQ ID NO 91 | nifL | N/A | N/A |
| CI63; CI063 | 63 | SEQ ID NO 92 | nifA | N/A | N/A |
| CI63; CI063 | 63 | SEQ ID NO 93 | glnE | N/A | N/A |
| CI63; CI063 | 63 | SEQ ID NO 94 | amtB | N/A | N/A |
| CI63; CI063 | 63 | SEQ ID NO 95 | PinfC | 500 bp immediately upstrea of the ATG start codon of the infC gene | N/A |

TABLE 26-continued

| WT and Remodeled Non-intergeneric Microbes | | | | | |
|---|---|---|---|---|---|
| Strain | Strain ID | SEQ ID NO | Genotype | Description | Associated Novel Junction If Applicable |
| CI137 | 137 | SEQ ID NO 96 | 16S | N/A | N/A |
| CI137 | 137 | SEQ ID NO 97 | nifH1 | 1 of 2 unique genes annotated as nifH in 137 genome | N/A |
| CI137 | 137 | SEQ ID NO 98 | nifH2 | 2 of 2 unique genes annotated as nifH in 137 genome | N/A |
| CI137 | 137 | SEQ ID NO 99 | nifD1 | 1 of 2 unique genes annotated as nifD in 137 genome | N/A |
| CI137 | 137 | SEQ ID NO 100 | nifD2 | 2 of 2 unique genes annotated as nifD in 137 genome | N/A |
| CI137 | 137 | SEQ ID NO 101 | nifK1 | 1 of 2 unique genes annotated as nifK in 137 genome | N/A |
| CI137 | 137 | SEQ ID NO 102 | nifK2 | 2 of 2 unique genes annotated as nifK in 137 genome | N/A |
| CI137 | 137 | SEQ ID NO 103 | nifL | N/A | N/A |
| CI137 | 137 | SEQ ID NO 104 | nifA | N/A | N/A |
| CI137 | 137 | SEQ ID NO 105 | glnE | N/A | N/A |
| CI137 | 137 | SEQ ID NO 106 | PinfC | 500 bp immediately upstream of the TTG start codon of infC | N/A |
| CI137 | 137 | SEQ ID NO 107 | amtB | N/A | N/A |
| CI137 | 137 | SEQ ID NO 108 | Prm8.2 | internal promoter located in nlpI gene; 299 bp starting at 81 bp after the A of the ATG of the nlpI gene | N/A |
| CI137 | 137 | SEQ ID NO 109 | Prm6.2 | 300 bp upstream of the secE gene starting at 57 bp upstream of the A of the ATG of secE | N/A |
| CI137 | 137 | SEQ ID NO 110 | Prm1.2 | 400 bp immediately upstream of the ATG of cspE gene | N/A |
| none | 728 | SEQ ID NO 111 | 16S | N/A | N/A |
| none | 728 | SEQ ID NO 112 | nifH | N/A | N/A |
| none | 728 | SEQ ID NO 113 | nifD1 | 1 of 2 unique genes annotated as nifD in 728 genome | N/A |
| none | 728 | SEQ ID NO 114 | nifD2 | 2 of 2 unique genes annotated as nifD in 728 genome | N/A |
| none | 728 | SEQ ID NO 115 | nifK1 | 1 of 2 unique genes annotated as nifK in 728 genome | N/A |
| none | 728 | SEQ ID NO 116 | nifK2 | 2 of 2 unique genes annotated as nifK in 728 genome | N/A |
| none | 728 | SEQ ID NO 117 | nifL | N/A | N/A |
| none | 728 | SEQ ID NO 118 | nifA | N/A | N/A |
| none | 728 | SEQ ID NO 119 | glnE | N/A | N/A |
| none | 728 | SEQ ID NO 120 | amtB | N/A | N/A |
| none | 850 | SEQ ID NO 121 | 16S | N/A | N/A |
| none | 852 | SEQ ID NO 122 | 16S | N/A | N/A |
| none | 853 | SEQ ID NO 123 | 16S | N/A | N/A |
| none | 910 | SEQ ID NO 124 | 16S | N/A | N/A |
| none | 910 | SEQ ID NO 125 | nifH | N/A | N/A |
| none | 910 | SEQ ID NO 126 | Dinitrogenase iron-molybdenum cofactor CDS | N/A | N/A |
| none | 910 | SEQ ID NO 127 | nifD1 | N/A | N/A |
| none | 910 | SEQ ID NO 128 | nifD2 | N/A | N/A |
| none | 910 | SEQ ID NO 129 | nifK1 | N/A | N/A |
| none | 910 | SEQ ID NO 130 | nifK2 | N/A | N/A |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| none | 910 | SEQ ID NO 131 | nifL | N/A | N/A |
| none | 910 | SEQ ID NO 132 | nifA | N/A | N/A |
| none | 910 | SEQ ID NO 133 | glnE | N/A | N/A |
| none | 910 | SEQ ID NO 134 | amtB | N/A | N/A |
| none | 910 | SEQ ID NO 135 | PinfC | 498 bp immediately upstream of the ATG of the infC gene | N/A |
| none | 1021 | SEQ ID NO 136 | 16S | N/A | N/A |
| none | 1021 | SEQ ID NO 137 | nifH | N/A | N/A |
| none | 1021 | SEQ ID NO 138 | nifD1 | 1 of 2 unique genes annotated as nifD in 910 genome | N/A |
| none | 1021 | SEQ ID NO 139 | nifD2 | 2 of 2 unique genes annotated as nifD in 910 genome | N/A |
| none | 1021 | SEQ ID NO 140 | nifK1 | 1 of 2 unique genes annotated as nifK in 910 genome | N/A |
| none | 1021 | SEQ ID NO 141 | nifK2 | 2 of 2 unique genes annotated as nifK in 910 genome | N/A |
| none | 1021 | SEQ ID NO 142 | nifL | N/A | N/A |
| none | 1021 | SEQ ID NO 143 | nifA | N/A | N/A |
| none | 1021 | SEQ ID NO 144 | glnE | N/A | N/A |
| none | 1021 | SEQ ID NO 145 | amtB | N/A | N/A |
| none | 1021 | SEQ ID NO 146 | PinfC | 500 bp immediately upstream of the ATG start codon of the infC gene | N/A |
| none | 1021 | SEQ ID NO 147 | Prm1 | 348 bp includes the 319 bp immediately upstream of the ATG start codon of the lpp gene and the first 29 bp of the lpp gene | N/A |
| none | 1021 | SEQ ID NO 148 | Prm7 | 339 bp upstream of the sspA gene, ending at 46 bp upstream of the ATG of the sspA gene | N/A |
| none | 1113 | SEQ ID NO 149 | 16S | N/A | N/A |
| none | 1113 | SEQ ID NO 150 | nifH | N/A | N/A |
| none | 1113 | SEQ ID NO 151 | nifD1 | 1 of 2 unique genes annotated as nifD in 1113 genome | N/A |
| none | 1113 | SEQ ID NO 152 | nifD2 | 2 of 2 unique genes annotated as nifD in 1113 genome | N/A |
| none | 1113 | SEQ ID NO 153 | nifK | N/A | N/A |
| none | 1113 | SEQ ID NO 154 | nifL | N/A | N/A |
| none | 1113 | SEQ ID NO 155 | nifA partial gene | due to a gap in the sequence assembly, we can only identify a partial gene from the 1113 genome | N/A |
| none | 1113 | SEQ ID NO 156 | glnE | N/A | N/A |
| none | 1116 | SEQ ID NO 157 | 16S | | N/A |
| none | 1116 | SEQ ID NO 158 | nifH | | N/A |
| none | 1116 | SEQ ID NO 159 | nifD1 | 1 of 2 unique genes annotated as nifD in 1116 genome | N/A |
| none | 1116 | SEQ ID NO 160 | nifD2 | 2 of 2 unique genes annotated as nifD in 1116 genome | N/A |
| none | 1116 | SEQ ID NO 161 | nifKl | 1 of 2 unique genes annotated as nifK in 1116 genome | N/A |
| none | 1116 | SEQ ID NO 162 | nifK2 | 2 of 2 unique genes annotated as nifK in 1116 genome | N/A |
| none | 1116 | SEQ ID NO 163 | nifL | N/A | N/A |
| none | 1116 | SEQ ID NO 164 | nifA | N/A | N/A |

TABLE 26-continued

| WT and Remodeled Non-intergeneric Microbes | | | | | |
|---|---|---|---|---|---|
| Strain | Strain ID | SEQ ID NO | Genotype | Description | Associated Novel Junction If Applicable |
| none | 1116 | SEQ ID NO 165 | glnE | N/A | N/A |
| none | 1116 | SEQ ID NO 166 | amtB | N/A | N/A |
| none | 1293 | SEQ ID NO 167 | 16S | N/A | N/A |
| none | 1293 | SEQ ID NO 168 | nifH | N/A | N/A |
| none | 1293 | SEQ ID NO 169 | nifD1 | 1 of 2 unique genes annotated as nifD in 1293 genome | N/A |
| none | 1293 | SEQ ID NO 170 | nifD2 | 2 of 2 unique genes annotated as nifD in 1293 genome | N/A |
| none | 1293 | SEQ ID NO 17 i | nifK | 1 of 2 unique genes annotated as nifK in 1293 genome | N/A |
| none | 1293 | SEQ ID NO 172 | nifK1 | 2 of 2 unique genes annotated as nifK in 1293 genome | N/A |
| none | 1293 | SEQ ID NO 173 | nifA | N/A | N/A |
| none | 1293 | SEQ ID NO 174 | glnE | N/A | N/A |
| none | 1293 | SEQ ID NO 175 | amtB1 | 1 of 2 unique genes annotated as amtB in 1293 genome | N/A |
| none | 1293 | SEQ ID NO 176 | amtB2 | 2 of 2 unique genes annotated as amtB in 1293 genome | N/A |
| none | 1021-1612 | SEQ ID NO 177 | ΔnifL::PinfC | starting at 24 bp after the A of the ATG start codon, 1375 bp of nifL have been deleted and replaced with the 1021 PinfC promoter sequence | ds1131 |
| none | 1021-1612 | SEQ ID NO 178 | ΔnifL::PinfC with 500 bp flank | starting at 24 bp after the A of the ATG start codon, 1375 bp of nifL have been deleted and replaced with the 1021 PinfC promoter sequence; 500 bp flanking the nifL gene upstream and downstream are included | ds1131 |
| none | 1021-1612 | SEQ ID NO 179 | glnEΔAR-2 | glnE gene with 1673 bp immediately downstream of the ATG start codon deleted, resulting in a truncated glnE protein lacking the adenylyl-removing (AR) domain | ds1133 |
| none | 1021-1612 | SEQ ID NO 180 | glnEΔAR-2 with 500 bp flank | glnE gene with 1673 bp immediately downstream of the ATG start codon deleted, resulting in a truncated glnE protein lacking the adenylyl-removing (AR) domain; 500 bp flanking the glnE gene upstream and downstream are included | ds1133 |
| none | 1021-1615 | SEQ ID NO 181 | ΔnifL::Prm1 | starting at 24 bp after the A of the ATG start codon, 1375 bp of nifL have been deleted and replaced with the 1021 Prm1 promoter sequence | ds1145 |
| none | 1021-1615 | SEQ ID NO 182 | ΔnifL::Prm1 with 500 bp flank | starting at 24 bp after the A of the ATG start codon, 1375 bp of nifL have been deleted and replaced with the 1021 rm1 promoter sequence; 500 bp flanking the nifL gene upstream and downstream are included | ds1145 |
| none | 1021-1615 | SEQ ID NO 183 | glnEΔAR-2 | glnE gene with 1673 bp immediately downstream of the ATG start codon deleted, resulting in a truncated glnE protein lacking the adenylyl-removing (AR) domain | ds1133 |
| none | 1021-1615 | SEQ ID NO 184 | glnEΔAR-2 with 500 bp flank | glnE gene with 1673 bp immediately downstream of the ATG start codon deleted, resulting in a truncated glnE protein lacking the adenylyl-removing (AR) domain; 500 bp flanking the glnE gene upstream and downstream are included | ds1133 |
| none | 1021-1619 | SEQ ID NO 185 | ΔnifL::Prm1 | starting at 24 bp after the A of the ATG start codon, 1375 bp of nifL have been deleted and replaced with the 1021 Prm1 promoter sequence | ds1145 |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| none | 1021-1619 | SEQ ID NO 186 | ΔnifL::Prm1 with 500 bp flank | starting at 24 bp after the A of the ATG start codon, 1375 bp of nifL have been deleted and replaced with the 1021 rm1 promoter sequence; 500 bp flanking the nifL gene upstream and downstream are included | ds1145 |
| none | 1021-1623 | SEQ ID NO 187 | glnEΔAR-2 | glnE gene with 1673 bp immediately downstream of the ATG start codon deleted, resulting in a truncated glnE protein lacking the adenylyl-removing (AR) domain | ds1133 |
| none | 1021-1623 | SEQ ID NO 188 | glnEΔAR-2 with 500 bp flank | glnE gene with 1673 bp immediately downstream of the ATG start codon deleted, resulting in a truncated glnE protein lacking the adenylyl-removing (AR) domain; 500 bp flanking the glnE gene upstream and downstream are included | ds1133 |
| none | 1021-1623 | SEQ ID NO 189 | ΔnifL::Prm7 | starting at 24 bp after the A of the ATG start codon, 1375 bp of nifL have been deleted and replaced with the 1021 Prm7 promoter sequence | ds1148 |
| none | 1021-1623 | SEQ ID NO 190 | ΔnifL::Prm7 with 500 bp flank | starting at 24 bp after the A of the ATG start codon, 1375 bp of nifL have been deleted and replaced with the 1021 rm7 promoter sequence; 500 bp flanking the nifL gene upstream and downstream are included | ds1148 |
| none | 137-1034 | SEQ ID NO 191 | glnEΔAR-2 | glnE gene with 1290 bp immediately downstream of the ATG start codon deleted, resulting in a truncated glnE protein lacking the adenylyl-removing (AR) domain | ds809 |
| none | 137-1034 | SEQ ID NO 192 | glnEΔAR-2 with 500 bp flank | glnE gene with 1290 bp immediately downstream of the ATG start codon deleted, resulting in a truncated glnE protein lacking the adenylyl-removing (AR) domain; 500 bp flanking the glnE gene upstream and downstream are included | ds809 |
| none | 137-1036 | SEQ ID NO 193 | ΔnifL::PinfC | starting at 24 bp after the A of the ATG start codon, 1372 bp of nifL have been deleted and replaced with the 137 PinfC promoter sequence | ds799 |
| none | 137-1036 | SEQ ID NO 194 | ΔnifL::PinfC with 500 bp flank | starting at 24 bp after the A of the ATG start codon, 1372 bp of nifL have been deleted and replaced with the 137 PinfC promoter sequence; 500 bp flanking the nifL gene upstream and downstream are included | ds799 |
| none | 137-1314 | SEQ ID NO 195 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain | none |
| none | 137-1314 | SEQ ID NO 196 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain; 500 bp flanking the nifL gene upstream and downstream are included | none |
| none | 137-1314 | SEQ ID NO 197 | ΔnifL::Prm8.2 | starting at 24 bp after the A of the ATG start codon, 1372 bp of nifL have been deleted and replaced with the 137 Prm8.2 promoter sequence | ds857 |
| none | 137-1314 | SEQ ID NO 198 | ΔnifL::Prm8.2 with 500 bp flank | starting at 24 bp after the A of the ATG start codon, 1372 bp of nifL have been deleted and replaced with the 137 Prm8.2 promoter sequence; 500 bp | ds857 |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| | | | | flanking the nifL gene upstream and dowmstream are included | |
| none | 137-1329 | SEQ ID NO 199 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain | none |
| none | 137-1329 | SEQ ID NO 200 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain; 500 bp flanking the nifL gene upstream and downstream are included | none |
| none | 137-1329 | SEQ ID NO 201 | ΔnifL::Prm6.2 | starting at 24 bp after the A of the ATG start codon, 1372 bp of nifL have been deleted and replaced with the 137 Prm6.2 promoter sequence | ds853 |
| none | 137-1329 | SEQ ID NO 202 | ΔnifL::Prm6.2 with 500 bp flank | starting at 24 bp after the A of the ATG start codon, 1372 bp of nifL have been deleted and replaced with the 137 Prm6.2 promoter sequence; 500 bp flanking the nifL gene upstream and downstream are included | ds853 |
| none | 137-1382 | SEQ ID NO 203 | ΔnifL::Prm1.2 | starting at 24 bp after the A of the ATG start codon, 1372 bp of nifL have been deleted and replaced with the 137 Prm1.2 promoter sequence | ds843 |
| none | 137-1382 | SEQ ID NO 204 | ΔnifL::Prm1.2 with 500 bp flank | starting at 24 bp after the A of the ATG start codon, 1372 bp of nifL have been deleted and replaced with the 137 Prm1.2 promoter sequence; 500 bp flanking the nifL gene upstream and downstream are included | ds843 |
| none | 137-1382 | SEQ ID NO 205 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain | none |
| none | 137-1382 | SEQ ID NO 206 | glnEΔAR-2 36 bp deletion | glnE gene with 1290 bp immediately downstream of the ATG start codon deleted AND 36 bp deleted beginning at 1472 bp downstream of the start codon, resulting in a truncated glnE protein lacking the adenylyl-removing (AR) domain; 500 bp flanking the nifL gene upstream and downstream are included | none |
| none | 137-1586 | SEQ ID NO 207 | ΔnifL::PinfC | starting at 24 bp after the A of the ATG start codon, 1372 bp of nifL have been deleted and replaced with the 137 PinfC promoter sequence | ds799 |
| none | 137-1586 | SEQ ID NO 208 | ΔnifL::PinfC with 500 bp flank | starting at 24 bp after the A of the ATG start codon, 1372 bp of nifL have been deleted and replaced with the 137 PinfC promoter sequence; 500 bp flanking the nifL gene upstream and downstream are included | ds799 |
| none | 137-1586 | SEQ ID NO 209 | glnEΔAR-2 | glnE gene with 1290 bp immediately downstream of the ATG start codon deleted, resulting in a truncated glnE protein lacking the adenylyl-removing (AR) domain | ds809 |
| none | 137-1586 | SEQ ID NO 210 | glnEΔAR-2 with 500 bp flank | glnE gene with 1290 bp immediately downstream of the ATG start codon deleted, resulting in a truncated glnE protein lacking the adenylyl-removing | ds809 |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| | | | | (AR) domain; 500 bp flanking the glnE gene upstream and downstream are included | |
| none | 19-594 | SEQ ID NO 211 | glnEΔAR-2 | glnE gene with 1650 bp immediately downstream of the ATG start codon deleted, resulting in a truncated glnE protein lacking the adenylyl-removing (AR) domain | ds34 |
| none | 19-594 | SEQ ID NO 212 | glnEΔAR-2 with 500 bp flank | glnE gene with 1650 bp immediately downstream of the ATG start codon deleted, resulting in a truncated glnE protein lacking the adenylyl-removing (AR) domain; 500 bp flanking the glnE gene upstream and downstream are included | ds34 |
| none | 19-59-1 | SEQ ID NO 213 | ΔnifL::Prm6.1 | starting at 221 bp after the A of the ATG start codon, 845 bp of nifL have been deleted and replaced with the CI019 Prm6.1 promoter sequence | ds180 |
| none | 19-594 | SEQ ID NO 214 | ΔnifL::Prm6.1 with 500 bp flank | starting at 221 bp after the A of the ATG start codon, 845 bp of nifL have been deleted and replaced with the CI019 Prm6.1promoter sequence; 500 bp flanking the nifL gene upstream and downstream are included | ds180 |
| none | 19-714 | SEQ ID NO 215 | ΔnifL::Prm6.1 | starting at 221 bp after the A of the ATG start codon, 845 bp of nifL have been deleted and replaced with the CI019 Prm6.1 promoter sequence | ds180 |
| none | 19-714 | SEQ ID NO 216 | ΔnifL::Prm6.1 with 500 bp flank | starting at 221 bp after the A of the ATG start codon, 845 bp of nifL have been deleted and replaced with the CI019 Prm6.1promoter sequence; 500 bp flanking the nifL gene upstream and downstream are included | ds180 |
| none | 19-715 | SEQ ID NO 217 | ΔnifL::Prm7.1 | starting at 221 bp after the A of the ATG start codon, 845 bp of nifL have been deleted and replaced with the CI019 Prm7.1 promoter sequence | ds181 |
| none | 19-715 | SEQ ID NO 218 | ΔnifL::Prm7.1 with 500 bp flank | starting at 221 bp after the A of the ATG start codon, 845 bp of nifL have been deleted and replaced with the CI019 Prm76.1promoter sequence; 500 bp flanking the nifL gene upstream and downstream are included | ds181 |
| 19-713 | 19-750 | SEQ ID NO 219 | ΔnifL::Prm1.2 | starting at 221 bp after the A of the ATG start codon, 845 bp of nifL have been deleted and replaced with the CI019 Prm1.2 promoter sequence | ds172 |
| 19-713 | 19-750 | SEQ ID NO 220 | ΔnifL::Prm1.2 with 500 bp flank | starting at 221 bp after the A of the ATG start codon, 845 bp of nifL have been deleted and replaced with the CI019 Prm1.2 promoter sequence; 500 bp flanking the nifL gene upstream and downstream are included | ds172 |
| 17-724 | 19-804 | SEQ ID NO 221 | ΔnifL::Prm1.2 | starting at 221 bp after the A of the ATG start codon, 845 bp of nifL have been deleted and replaced with the CI019 Prm1.2 promoter sequence | ds172 |
| 17-724 | 19-804 | SEQ ID NO 222 | ΔnifL::Prm1.2 with 500 bp flank | starting at 221 bp after the A of the ATG start codon, 845 bp of nifL have been deleted and replaced with the CI019 Prm1.2 promoter sequence; 500 bp flanking the nifL gene upstream and downstream are included | ds172 |
| 17-724 | 19-804 | SEQ ID NO 223 | glnEΔAR-2 | glnE gene with 1650 bp immediately downstream of the ATG start codon deleted, resulting in a truncated glnE protein lacking the adenylyl-removing (AR) domain | ds34 |

TABLE 26-continued

| WT and Remodeled Non-intergeneric Microbes | | | | | |
|---|---|---|---|---|---|
| Strain | Strain ID | SEQ ID NO | Genotype | Description | Associated Novel Junction If Applicable |
| 17-724 | 19-804 | SEQ ID NO 224 | glnEΔAR-2 with 500 bp flank | glnE gene with 1650 bp immediately dowmstream of the ATG start codon deleted, resulting in a truncated glnE protein lacking the adenylyl-removing (AR) domain; 500 bp flanking the glnE gene upstream and downstream are included | ds34 |
| 19-590 | 19-806 | SEQ ID NO 225 | ΔnifL::Prm3.1 | starting at 221 bp after the A of the ATG start codon, 845 bp of nifL have been deleted and replaced with the CI019 Prm3.1 promoter sequence | ds175 |
| 19-590 | 19-806 | SEQ ID NO 226 | ΔnifL::Prm3.1 with 500 bp flank | starting at 221 bp after the A of the ATG start codon, 845 bp of nifL have been deleted and replaced with the CI019 Prm3.1 promoter sequence; 500 bp flanking the nifL gene upstream and downstream are included | ds175 |
| 19-590 | 19-806 | SEQ ID NO 227 | glnEΔAR-2 | glnE gene with 1650 bp immediately downstream of the ATG start codon deleted, resulting in a truncated glnE protein lacking the adenylyl-removing (AR) domain | ds34 |
| 19-590 | 19-806 | SEQ ID NO 228 | glnEΔAR-2 with 500 bp Hank | glnE gene with 1650 bp immediately downstream of the ATG start codon deleted, resulting in a truncated glnE protein lacking the adenylyl-removing (AR) domain; 500 bp flanking the glnE gene upstream and downstream are included | ds34 |
| none | 63-1146 | SEQ ID NO 229 | ΔnifL::PinfC | starting at 24 bp after the A of the ATG start codon, 1375 bp of nifL have been deleted and replaced with the 63 PinfC promoter sequence | ds908 |
| none | 63-1146 | SEQ ID NO 230 | ΔnifL::PinfC with 500 bp flank | starting at 24 bp after the A of the ATG start codon, 1375 bp of nifL have been deleted and replaced with the 63 PinfC promoter sequence; 500 bp flanking the nifL gene upstream and downstream are included | ds908 |
| CM015; PBC6.15 | 6-397 | SEQ ID NO 231 | ΔnifL::Prm5 | starting at 31 bp after the A of the ATG start codon, 1375 bp of nifL have been deleted and replaced with the CI006 Prm5 promoter sequence | ds24 |
| CM015; PBC6.15 | 6-397 | SEQ ID NO 232 | ΔnifL::Prm5 with 500 bp flank | starting at 31 bp after the A of the ATG start codon, 1375 bp of nifL have been deleted and replaced with the CI006 Prm5 promoter sequence; 500 bp flanking the nifL gene upstream and downstream are included | ds24 |
| CM014 | 6-400 | SEQ ID NO 233 | ΔnifL::Prm1 | starting at 31 bp after the A of the ATG start codon, 1375 bp of nifL have been deleted and replaced with the CI006 Prm1 promoter sequence | ds20 |
| CM014 | 6-400 | SEQ ID NO 234 | ΔnifL::Prm1 with 500 bp Hank | starting at 31 bp after the A of the ATG start codon, 1375 bp of nifL have been deleted and replaced with the CI006 Prm1 promoter sequence; 500 bp flanking the nifL gene upstream and downstream are included | ds20 |
| CM037; PBC6.37 | 6-403 | SEQ ID NO 235 | ΔnifL::Prm1 | starting at 31 bp after the A of the ATG start codon, 1375 bp of nifL have been deleted and replaced with the CI006 Prm1 promoter sequence | ds20 |
| CM037; PBC6.38 | 6-403 | SEQ ID NO 236 | ΔnifL::Prm1 with 500 bp flank | starting at 31 bp after the A of the ATG start codon, 1375 bp of nifL have been deleted and replaced with the CI006 Prm1 promoter sequence; 500 bp flanking the nifL gene upstream and downstream are included | ds20 |

TABLE 26-continued

| WT and Remodeled Non-intergeneric Microbes | | | | | |
|---|---|---|---|---|---|
| Strain | Strain ID | SEQ ID NO | Genotype | Description | Associated Novel Junction If Applicable |
| CM037; PBC6.39 | 6-403 | SEQ ID NO 237 | glnEΔAR-2 | glnE gene with 1644 bp immediately downstream of the ATG start codon deleted, resulting in a truncated glnE protein lacking the adenylyl-removing (AR) domain | ds31 |
| CM037; PBC6.40 | 6-403 | SEQ ID NO 238 | glnEΔAR-2 with 500 bp flank | glnE gene with 1644 bp immediately downstream of the ATG start codon deleted, resulting in a truncated glnE protein lacking the adenylyl-removing (AR) domain; 500 bp flanking the glnE gene upstream and downstream are included | ds31 |
| CM038; PBC6.38 | 6-404 | SEQ ID NO 239 | glnEΔAR-1 | glnE gene with 1287 bp immediately downstream of the ATG start codon deleted, resulting in a truncated glnE protein lacking the adenylyl-removing (AR) domain | ds30 |
| CM038; PBC6.38 | 6-404 | SEQ ID NO 240 | ΔnifL::Prm1 | starting at 31 bp after the A of the ATG start codon, 1375 bp of nifL have been deleted and replaced with the CI006 Prm1 promoter sequence | ds20 |
| CM038; PBC6.38 | 6-404 | SEQ ID NO 241 | ΔnifL::Prm1 with 500 bp flank | starting at 31 bp after the A of the ATG start codon, 1375 bp of nifL have been deleted and replaced with the CI006 Prm1 promoter sequence; 500 bp flanking the nifL eene upstream and downstream are included | ds20 |
| CM038; PBC6.38 | 6-404 | SEQ ID NO 242 | glnEΔAR-1 with 500 bp flank | glnE gene with 1287 bp immediately downstream of the ATG start codon deleted, resulting in a truncated glnE protein lacking the adenylyl-removing (AR) domain; 500 bp flanking the glnE gene upstream and downstream are included | ds30 |
| CM029; PBC6.29 | 6-412 | SEQ ID NO 243 | glnEΔAR-1 | glnE gene with 1287 bp immediately downstream of the ATG start codon deleted, resulting in a truncated glnE protein lacking the adenylyl-removing (AR) domain | ds30 |
| CM029; PBC6.29 | 6-412 | SEQ ID NO 244 | glnEΔAR-1 with 500 bp flank | glnE gene with 1287 bp immediately downstream of the ATG start codon deleted, resulting in a truncated glnE protein lacking the adenylyl-removing (AR) domain; 500 bp flanking the glnE gene upstream and downstream are included | ds30 |
| CM029; PBC6.29 | 6-412 | SEQ ID NO 245 | ΔnifL::Pmr5 | starting at 31 bp after the A of the ATG start codon, 1375 bp of nifL have been deleted and replaced with the CI006 Prm5 promoter sequence | ds24 |
| CM029; PBC6.29 | 6-412 | SEQ ID NO 246 | ΔnifL::Prm5 with 500 bp flank | starting at 31 bp after the A of the ATG start codon, 1375 bp of nifL, have been deleted and replaced with the CI006 Prm5 promoter sequence; 500 bp flanking the nifL gene upstream and downstream are included | ds24 |
| CM093; PBC6.93 | 6-848 | SEQ ID NO 247 | ΔnifL::Prm1 | starting at 31 bp after the A of the ATG start codon, 1375 bp of nifL have been deleted and replaced with the CI006 Prm1 promoter sequence | ds20 |
| CM093; PBC6.93 | 6-848 | SEQ ID NO 248 | ΔnifL::Prm1 with 500 bp flank | starting at 31 bp after the A of the ATG start codon, 1375 bp of nifL have been deleted and replaced with the CI006 Prm1 promoter sequence; 500 bp flanking the nifL gene upstream and downstream are included | ds20 |
| CM093; PBC6.93 | 6-848 | SEQ ID NO 249 | glnEΔAR-2 | glnE gene with 1644 bp immediately dowmstream of the ATG start codon deleted, resulting in a truncated glnE protein lacking the adenylyl-removing (AR) domain | ds31 |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| CM093; PBC6.93 | 6-848 | SEQ ID NO 250 | glnEΔAR-2 with 500 bp flank | glnE gene with 1644 bp immediately downstream of the ATG start codon deleted, resulting in a truncated glnE protein lacking the adenylyl-removing (AR) domain; 500 bp flanking the glnE gene upstream and downstream are included | ds31 |
| CM093; PBC6.93 | 6-848 | SEQ ID NO 251 | ΔamtB | First 1088 bp of amtB gene and 4 bp upstream of start codon deleted; 199 bp of gene remaining lacks a start codon; no amtB protein is translated | ds126 |
| CM093; PBC6.93 | 6-848 | SEQ ID NO 252 | ΔamtB with 500 bp flank | First 1088 bp of amtB gene and 4 bp upstream of start codon deleted; 199 bp of gene remaining lacks a start codon; no amtB protein is translated | ds126 |
| CM094; PBC6.94 | 6-881 | SEQ ID NO 253 | glnEΔAR-1 | glnE gene with 1287 bp immediately downstream of the ATG start codon deleted, resulting in a truncated glnE protein lacking the adenylyl-removing (AR) domain | ds30 |
| CM094; PBC6.94 | 6-881 | SEQ ID NO 254 | glnEΔAR-1 with 500 bp flank | glnE gene with 1287 bp immediately downstream of the ATG start codon deleted, resulting in a truncated glnE protein lacking the adenylyl-removing (AR) domain; 500 bp flanking the glnE gene upstream and downstream are included | ds30 |
| CM094; PBC6.94 | 6-881 | SEQ ID NO 255 | ΔnifL::Prm1 | starting at 31 bp after the A of the ATG start codon, 1375 bp of nifL have been deleted and replaced with the CI006 Prm1 promoter sequence | ds20 |
| CM094; PBC6.94 | 6-881 | SEQ ID NO 256 | ΔnifL::Prm1 with 500 bp flank | starting at 31 bp after the A of the ATG start codon, 1375 bp of nifL have been deleted and replaced with the CI006 Prm1 promoter sequence; 500 bp flanking the nifL gene upstream and dowmstream are included | ds20 |
| CM094; PBC6.94 | 6-881 | SEQ ID NO 257 | ΔamtB | First 1088 bp of amtB gene and 4 bp upstream of start codon deleted; 199 bp of gene remaining lacks a start codon; no amtB protein is translated | ds126 |
| CM094; PBC6.94 | 6-881 | SEQ ID NO 258 | ΔamtB with 500 bp flank | First 1088 bp of amtB gene and 4 bp upstream of start codon deleted; 199 bp of gene remaining lacks a start codon; no amtB protein is translated | ds126 |
| none | 910-1246 | SEQ ID NO 259 | ΔnifL::PinfC | starting at 20 bp after the A of the ATG start codon, 1379 bp of nifL have been deleted and replaced with the 910 PinfC promoter sequence | ds960 |
| none | 910-1246 | SEQ ID NO 260 | ΔnifL::PinfC with 500 bp flank | starting at 20 bp after the A of the ATG start codon, 1379 bp of nifL have been deleted and replaced with the 910 PinfC promoter sequence; 500 bp flanking the nifL gene upstream and downstream are included | ds960 |
| PBC6.1, 6, CI6 | CI006 | SEQ ID NO 261 | 16S-1 | 1 of 3 unique 16S rDNA genes in the CI006 genome | N/A |
| PBC6.1, 6, CI6 | CI006 | SEQ ID NO 262 | 16S-2 | 2 of 3 unique 16S rDNA genes in the CI006 genome | N/A |
| PBC6.1, 6. CI6 | CI006 | SEQ ID NO 263 | nifH | N/A | N/A |
| PBC6.1, 6. CI6 | CI006 | SEQ ID NO 264 | nifD2 | 2 of 2 unique genes annotated as nifD in CI006 genome | N/A |
| PBC6.1, 6. CI6 | CI006 | SEQ ID NO 265 | nifK2 | 2 of 2 unique genes annotated as nifK in CI006 genome | N/A |
| PBC6.1, 6, CI6 | CI006 | SEQ ID NO 266 | nifL | N/A | N/A |
| PBC6.1, 6, CI6 | CI006 | SEQ ID NO 267 | nifA | N/A | N/A |
| PBC6.1, 6, CI6 | CI006 | SEQ ID NO 268 | glnE | N/A | N/A |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| PBC6.1, 6, CI6 | CI006 | SEQ ID NO 269 | 16S-3 | 3 of 3 unique 16S rDNA genes in the CI006 genome | N/A |
| PBC6.1, 6, CI6 | CI006 | SEQ ID NO 270 | nifD1 | 1 of 2 unique genes annotated as nifD in CI006 genome | N/A |
| PBC6.1, 6, CI6 | CI006 | SEQ ID NO 271 | nifK1 | 1 of 2 unique genes annotated as nifK in CI006 genome | N/A |
| PBC6.1, 6, CI6 | CI006 | SEQ ID NO 272 | amtB | N/A | N/A |
| PBC6.1, 6, CI6 | CI006 | SEQ ID NO 273 | Prm1 | 348 bp includes the 319 bp immediately upstream of the ATG start codon of the lpp gene and the first 29 bp of the lpp gene | N/A |
| PBC6.1, 6, CI6 | CI006 | SEQ ID NO 274 | Prm5 | 313 bp starting at 432 bp upstream of the ATG start codon of the ompX gene and ending 119 bp upstream of the ATG start codon of the ompX gene | N/A |
| 19, CI19 | CI019 | SEQ ID NO 275 | nifL | N/A | N/A |
| 19, CI19 | CI019 | SEQ ID NO 276 | nifA | N/A | N/A |
| 19, CI19 | CI019 | SEQ ID NO 277 | 16S-1 | 1 of 7 unique 16S rDNA genes in the CI019 genome | N/A |
| 19, CI19 | CI019 | SEQ ID NO 278 | 16S-2 | 2 of 7 unique 16S rDNA genes in the CI019 genome | N/A |
| 19, CI19 | CI019 | SEQ ID NO 279 | 16S-3 | 3 of 7 unique 16S rDNA genes in the CI019 genome | N/A |
| 19, CI19 | CI019 | SEQ ID NO 280 | 16S-4 | 4 of 7 unique 16S rDNA genes in the CI019 genome | N/A |
| 19, CI19 | CI019 | SEQ ID NO 281 | 16S-5 | 5 of 7 unique 16S rDNA genes in the CI019 genome | N/A |
| 19, CI19 | CI019 | SEQ ID NO 282 | 16S-6 | 6 of 7 unique 16S rDNA genes in the CI019 genome | N/A |
| 19, CI19 | CI019 | SEQ ID NO 283 | 16S-7 | 7 of 7 unique 16S rDNA genes in the CI019 genome | N/A |
| 19, CI19 | CI019 | SEQ ID NO 284 | nifH1 | 1 of 2 unique genes annotated as nifH in CI019 genome | N/A |
| 19, CI19 | CI019 | SEQ ID NO 285 | nifH2 | 2 of 2 unique genes annotated as nifH in CI019 genome | N/A |
| 19, CI19 | CI019 | SEQ ID NO 286 | nifD1 | 1 of 2 unique genes annotated as nifD in CI019 genome | N/A |
| 19, CI19 | CI019 | SEQ ID NO 287 | nifD2 | 2 of 2 unique genes annotated as nifD in CI019 genome | N/A |
| 19, CI19 | CI019 | SEQ ID NO 288 | nifK1 | I of 2 unique genes annotated as nifK in CI019 genome | N/A |
| 19, CI19 | CI019 | SEQ ID NO 289 | nifK2 | 2 of 2 unique genes annotated as nifK in CI019 genome | N/A |
| 19, CI19 | CI019 | SEQ ID NO 290 | glnE | N/A | N/A |
| 19, CI19 | CI019 | SEQ ID NO 291 | Prm4 | 449 bp immediately upstream of the ATG of the dscC 2 gene | N/A |
| 19, CI19 | CI019 | SEQ ID NO 292 | Prm1.2 | 500 bp immediately upstream of the TTG start codon of the infC gene | N/A |
| 19, CI19 | CI019 | SEQ ID NO 293 | Prm3.1 | 170 bp immediately upstream of the ATG start codon of the rplN gene | N/A |
| 19, CI20 | CI020 | SEQ ID NO 294 | Prm6.1 | 142 bp immediately upstream of the ATG of a highly-expressed hypothetical protein (annotated as PROKKA_00662 in CI019 assemble 82) | N/A |
| 19, CI21 | CI021 | SEQ ID NO 295 | Prm7.1 | 293 bp immediately upstream of the ATG of the lpp gene | N/A |
| 19-375, 19-417, CM067 | CM67 | SEQ ID NO 296 | glnEΔAR-2 | glnE gene with 1650 bp immediately downstream of the ATG start codon deleted, resulting in a truncated glnE protein lacking the adenylyl-removing (AR) domain | ds34 |
| 19-375, 19-417, CM067 | CM67 | SEQ ID NO 297 | glnEΔAR-2 with 500 bp Rank | glnE gene with 1650 bp immediately downstream of the ATG start codon deleted, resulting in a truncated glnE protein lacking the adenylyl-removing (AR) domain; 500 bp flanking the glnE gene upstream and downstream are included | ds34 |

TABLE 26-continued

WT and Remodeled Non-intergeneric Microbes

| Strain | Strain ID | SEQ ID NO | Genotype | Description | Associated Novel Junction If Applicable |
|---|---|---|---|---|---|
| 19-375, 19-417, CM067 | CM67 | SEQ ID NO 298 | ΔnifL::null-v1 | starting at 221 bp after the A of the ATG start codon, 845 bp of nifL have been deleted and replaced with the 31 bp sequence "GGAGTCTGAACTCATCCTGCGATGGGGGCTG" | none |
| 19-375, 19-417, CM067 | CM67 | SEQ ID NO 299 | ΔnifL::null-v1 with 500 bp Rank | starting at 221 bp after the A of the ATG start codon, 845 bp of nifL have been deleted and replaced with the 31 bp sequence "GGAGTCTGAACTCATCCTGCGATGGGGGCTG"; 500 bp Ranking the nifL gene upstream and downstream are included | none |
| 19-377, CM069 | CM69 | SEQ ID NO 300 | ΔnifL::null-v2 | starting at 221 bp after the A of the ATG start codon, 845 bp of nifL have been deleted and replaced with the 5 bp sequence "TTAAA" | none |
| 19-377, CM069 | CM69 | SEQ ID NO 301 | ΔnifL::null-v2 with 500 bp Hank | starting at 221 bp after the A of the ATG start codon, 845 bp of nifL have been deleted and replaced with the 5 bp sequence "TTAAA"; 500 bp flanking the nifL gene upstream and downstream are included | none |
| 19-389, 19-418, CM081 | CM81 | SEQ ID NO 302 | ΔnifL::Prm4 | starting at 221 bp after the A of the ATG start codon, 845 bp of nifL have been deleted and replaced with the CI19 Prm4 sequence | ds70 |
| 19-389, 19-418, CM081 | CM81 | SEQ ID NO 303 | ΔnifL::Prm4 with 500 bp flank | starting at 221 bp afterthe A of the ATG start codon, 845 bp of nifL have been deleted and replaced with the CI19 Prm4 sequence; 500 bp flanking the nifL gene upstream and downstream are included | ds70 |
| none | 137-3890 | SEQ ID NO 458 | ΔnifL-Prm1.2 | starting at 24 bp after the A of the ATG start codon, 1372 bp of nifL have been deleted and replaced with the 137 Prm1.2 promoter sequence | ds843 |
| none | 137-3890 | SEQ ID NO 459 | ΔnifL-Prm1.2 with 500 bp flank | starting at 24 bp after the A of the ATG start codon, 1372 bp of nifL have been deleted and replaced with the 137 Prm1.2 promoter sequence; 500 bp flanking the nifL gene upstream and downstream are included | ds843 |
| none | 137-3890 | SEQ ID NO 460 | glnE_KO2 | glnE gene with 1290 bp immediately downstream of the ATG start codon deleted, resulting in a truncated glnE protein lacking the adenylyl-removing (AR) domain | ds809 |
| none | 137-3890 | SEQ ID NO 461 | glnE_KO2 with 500 bp flank | glnE gene with 1290 bp immediately downstream of the ATG start codon deleted, resulting in a truncated glnE protein lacking the adenylyl-removing (AR) domain; 500 bp flanking the glnE gene upstream and downstream are included | ds809 |
| none | 137-3890 | SEQ ID NO 462 | NtrC_D54A | Deactivation of the phosphorylation site of the DNA-binding transcriptional regulator NrtC by swapping the 54th amino acid from aspartate to alanine (D to A) by changing the GAT codon to GCT. Disables the ability of NtrC to be phosphorylated. | ds2974 |
| none | 137-3890 | SEQ ID NO 463 | NtrC_D54A with Hanking sequences | Deactivation of the phosphorylation site of the DNA-binding transcriptional regulator NrtC by swapping the 54th amino acid from aspartate to alanine (D to A) by changing the GAT codon to GCT. Disables the ability of NtrC to be phosphorylated. 693 bp upstream and 549 bp downstream NtrC sequences flanking NtrCD54A mutation are included. | ds2974 |

TABLE 26-continued

| WT and Remodeled Non-intergeneric Microbes | | | | | |
|---|---|---|---|---|---|
| Strain | Strain ID | SEQ ID NO | Genotype | Description | Associated Novel Junction If Applicable |
| none | 137-3896 | SEQ ID NO 464 | ΔnifL::PinfC | Deletion of the nifL gene from 20 bp after the ATG (start) to 87 bp before the TGA (stop) of the gene. A 500 bp fragment from the region upstream of the infC gene was inserted (PinfC) upstream of nifA replacing the deleted portion. | ds799 |
| none | 137-3896 | SEQ ID NO 465 | ΔnifL::PinfC with flanking sequences | Deletion of the nifL gene from 20 bp after the ATG (start) to 87 bp before the TGA (stop) of the gene. A 500 bp fragment from the region upstream of the infC gene was inserted (PinfC) upstream of nifA replacing the deleted portion; 332 bp upstream and 324 bp downstream flanking the nifL gene are included. | ds799 |
| none | 137-3896 | SEQ ID NO 466 | glnD_UTase_Deactivation | Deactivation of the uridylyltransferase (UT) domain of the bifunctional uridylyltransferase/uridylyl-removing enzyme, glnD, by mutating amino acid residues 90 and 91 from GG to DV as well as residue 104 from D to A. | ds2538 |
| none | 137-3896 | SEQ ID NO 467 | glnD_UTase_Deactivation with flanking sequences | Deactivation of the uridylyltransferase (UT) domain of the bifunctional uridylyltransferase/uridylyl-removing enzyme, glnD, by mutating amino acid residues 90 and 91 from GG to DV as well as residue 104 from D to A; 450 bp flanking the mutated sites upstream and downstream are included. | ds2538 |
| none | 137-3896 | SEQ ID NO 468 | NC-nifA_copy::Prm1.2 | Insertion of a copy of the nifA gene into a noncoding region of 137. This copy is being driven by a 400 bp promoter (Prm1.2) derived from a region upstream of the cspE gene. | ds2969 |
| none | 137-3896 | SEQ ID NO 469 | NC-nifA_copy::Prm1.2 with flanking sequences | Insertion of a copy of the nifA gene into a noncoding region of 137. This copy is being driven by a 400 bp promoter (Prm1.2) derived from a region upstream of the cspE gene; 2000 bp flanking the insertion site upstream and downstream are included. | ds2969 |

TABLE 27

| Microbial Detection | | | | | | | | | | |
|---|---|---|---|---|---|---|---|---|---|---|
| base CI | Junction Name | up/down stream junction | SEQ ID NO (comprising 100 bp upstream of junction) | SEQ ID NO (comprising 100 bp downstream of junction) | SEQ ID NO (Junction sequence comprising 100 bp upstream and 100 bp downstream of junction) | Junction description | F primer SEQ | R primer SEQ | Probe SEQ |
| 1021 | ds1131 | up | 304 | 338 | 372 | disrupted nifL gene/ PinfC | N/A | N/A | N/A |
| 1021 | ds1131 | down | 305 | 339 | 373 | PinfC/ disrupted nifL gene | N/A | N/A | N/A |
| 1021 | ds1133 | N/A | 306 | 340 | 374 | 5' UTR and ATG/ truncated glnE gene | N/A | N/A | N/A |
| 1021 | ds1145 | up | 307 | 341 | 375 | disrupted nifL gene/ Prm1 | N/A | N/A | N/A |
| 1021 | ds1145 | down | 308 | 342 | 376 | Prm1/ disrupted nifL gene | N/A | N/A | N/A |

TABLE 27-continued

Microbial Detection

| base CI | Junction Name | up/down stream junction | SEQ ID NO (comprising 100 bp upstream of junction) | SEQ ID NO (comprising 100 bp downstream of junction) | SEQ ID NO (Junction sequence comprising 100 bp upstream and 100 bp downstream of junction) | Junction description | F primer SEQ | R primer SEQ | Probe SEQ |
|---|---|---|---|---|---|---|---|---|---|
| 1021 | ds1148 | up | 309 | 343 | 377 | disrupted nifL gene/ Prm7 | N/A | N/A | N/A |
| 1021 | ds1148 | down | 310 | 344 | 378 | Prm4/ disrupted nifL gene | N/A | N/A | N/A |
| CI006 | ds126 | N/A | 311 | 345 | 379 | 5' UTR up to ATG-4 bp of amtB gene/ disrupted amtB gene | N/A | N/A | N/A |
| CI019 | ds172 | down | 312 | 346 | 380 | Prm1.2/ disrupted nifL gene | SEQ ID NO: 406 C | SEQ ID NO: 407 | N/A |
| CI019 | ds172 | up | 313 | 347 | 381 | disrupted nifL gene/ Prm1.2 | N/A | N/A | N/A |
| CI019 | ds175 | down | 314 | 348 | 382 | Prm3.1/ disrupted nifL gene | SEQ ID NO: 408 | SEQ ID NO: 409 | SEQ ID NO: 410 |
| CI019 | ds175 | up | 315 | 349 | 383 | disrupted nifL gene/ Prm3.1 | N/A | N/A | N/A |
| CI006 | ds20 | down | 316 | 350 | 384 | Prm1/ disrupted nifL gene | SEQ ID NO: 411 | SEQ ID NO: 412 | SEQ ID NO: 413 |
| CI006 | ds20 | up | 317 | 351 | 385 | disrupted nifL gene/ Prm1 | N/A | N/A | N/A |
| CI006 | ds24 | up | 318 | 352 | 386 | disrupted nifL gene/ Prm5 | SEQ ID NO: 414 | SEQ ID NO: 415 | SEQ ID NO: 416 |
| CI006 | ds24 | down | 319 | 353 | 387 | Prm5/ disrupted nifL gene | N/A | N/A | N/A |
| CI006 | ds30 | N/A | 320 | 354 | 388 | 5' UTR and ATG/ truncated glnE gene | N/A | N/A | N/A |
| CI006 | ds31 | N/A | 321 | 355 | 389 | 5' UTR and ATG/ truncated glnE gene | N/A | N/A | N/A |
| CI019 | ds34 | N/A | 322 | 356 | 390 | 5' UTR and ATG/ truncated glnE gene | N/A | N/A | N/A |
| CI019 | ds70 | up | 323 | 357 | 391 | disrupted nifL gene/ Prm4 | N/A | N/A | N/A |
| CI019 | ds70 | down | 324 | 358 | 392 | Prm4/ disrupted nifL gene | N/A | N/A | N/A |
| 137 | ds799 | down | 325 | 359 | 393 | PinfC/ disrupted nifL gene | SEQ ID NO: 417 | SEQ ID NO: 418 | SEQ ID NO: 419 |
| 137 | ds799 | up | 326 | 360 | 394 | disrupted nifL gene/ PinfC | N/A | N/A | N/A |
| 137 | ds809 | N/A | 327 | 361 | 395 | 5' UTR and ATG/ truncated glnE gene | SEQ ID NO: 420 | SEQ ID NO: 421 | SEQ ID NO: 422 |
| 137 | ds843 | up | 328 | 362 | 396 | disrupted nifL gene/ Prm1.2 | N/A | N/A | N/A |
| 137 | ds843 | down | 329 | 363 | 397 | Prm1.2/ disrupted nifL gene | N/A | N/A | N/A |
| 137 | ds853 | up | 330 | 364 | 398 | disrupted nifL gene/ Prm6.2 | N/A | N/A | N/A |

TABLE 27-continued

| Microbial Detection | | | | | | | | | |
|---|---|---|---|---|---|---|---|---|---|
| base CI | Junction Name | up/down stream junction | SEQ ID NO (comprising 100 bp upstream of junction) | SEQ ID NO (comprising 100 bp downstream of junction) | SEQ ID NO (Junction sequence comprising 100 bp upstream and 100 bp downstream of junction) | Junction description | F primer SEQ | R primer SEQ | Probe SEQ |
| 137 | ds853 | down | 331 | 365 | 399 | Prm6.2/ disrupted nifL gene | N/A | N/A | N/A |
| 137 | ds857 | up | 332 | 366 | 400 | disrupted nifL gene/ Prm8.2 | N/A | N/A | N/A |
| 137 | ds857 | down | 333 | 367 | 401 | Prm8.2/ disrupted nifL gene | N/A | N/A | N/A |
| 63 | ds908 | down | 334 | 368 | 402 | PinfC/ disrupted nifL gene | SEQ ID NO: 423 | SEQ ID NO: 424 | N/A |
| 63 | ds908 | up | 335 | 369 | 403 | disrupted nifL gene/ PinfC | N/A | N/A | N/A |
| 910 | ds960 | up | 336 | 370 | 404 | disrupted nifL gene/ PinfC | N/A | N/A | N/A |
| 910 | ds960 | down | 337 | 371 | 405 | PinfC/ disrupted nifL gene | N/A | N/A | N/A |
| 137 | ds843 | up | 425 | 436 | 447 | 5' upstream region of nifL/Prm1.2 | N/A | N/A | N/A |
| 137 | ds843 | down | 426 | 437 | 448 | Prm1.2/nifA | N/A | N/A | N/A |
| 137 | ds809 | up | 427 | 438 | 449 | 1647 bp deletion of glnE N-terminus after the start codon. | N/A | N/A | N/A |
| 137 | ds2974 | up | 428 | 439 | 450 | 5' region of NtrC upstream of D54A (GAT--> GCT) | N/A | N/A | N/A |
| 137 | ds2974 | down | 429 | 440 | 451 | NtrC sequence downstream of the D54A (GAT--> GCT) mutation | N/A | N/A | N/A |
| 137 | 799 | up | 430 | 441 | 452 | 5' upstream region of nifL/PinfC | N/A | N/A | N/A |
| 137 | 799 | down | 431 | 442 | 453 | PinfC/nifA | N/A | N/A | N/A |
| 137 | ds2538 | up | 432 | 443 | 454 | 5' upstream region of glnD-Utase deactivation mutation. | N/A | N/A | N/A |
| 137 | ds2538 | down | 433 | 444 | 455 | 3' downstream region of glnD-Utase deactivation mutation. | N/A | N/A | N/A |
| 137 | ds2969 | up | 434 | 445 | 456 | 5' upstream of an extra copy of Prm1.2_nif A gene inserted in a non-coding site of *Klebsiella* genome between two hypothetical coding sequences. | N/A | N/A | N/A |

TABLE 27-continued

| Microbial Detection | | | | | | | | | |
|---|---|---|---|---|---|---|---|---|---|
| base CI | Junction Name | up/down stream junction | SEQ ID NO (comprising 100 bp upstream of junction) | SEQ ID NO (comprising 100 bp downstream of junction) | SEQ ID NO (Junction sequence comprising 100 bp upstream and 100 bp downstream of junction) | Junction description | F primer SEQ | R primer SEQ | Probe SEQ |
| 137 | ds2969 | down | 435 | 446 | 457 | 3' downstream of an extra copy of Prm1.2_nif A gene inserted in a non-coding site of *Klebsiella* genome between two hypothetical coding sequences. | N/A | N/A | N/A |

Numbered Embodiments of the Disclosure

Notwithstanding the appended claims, the disclosure sets forth the following numbered embodiments:

1. A composition comprising:
   (i) one or more isolated bacteria, and
   (ii) one or more biofilms produced by one or more microbes;
   wherein the one or more biofilms are exogenous to the one or more isolated bacteria.
2. The composition of embodiment 1, wherein the one or more isolated bacteria are selected from the following genera: *Achromobacter, Agrobacterium, Anabaena, Azorhizobium, Azospirillum, Azotobacter, Bacillus, Bradyrhizobium, Candida, Clostridium, Enterobacter, Klebsiella. Kluyvera*, Kosakonia. *Mesorhizobium, Microbacterium, Pseudomonas, Rahnella, Rhizobium, Saccharomyces*, and *Sinorhizobium.*
3. The composition of embodiment 1 or 2, wherein the one or more isolated bacteria are selected from: *Achromobacter marplatensis, Achromobacter spiritinus, Azospirillum lipoferum, Enterobacter* sp., *Klebsiella variicola, Kluyvera intermedia, Kosakonia pseudosacchari, Kosakonia sacchari, Microbacterium murale, Rahnella aquatilis*, and combinations thereof.
4. The composition of embodiment 1, wherein the one or more isolated bacteria is from the genus *Klebsiella.*
5. The composition of embodiment 1, wherein the one or more isolated bacteria is a *Klebsiella variicola.*
6. The composition of embodiment 1. wherein the one or more isolated bacteria is a *Klebsiella variicola* 137-1036 strain.
7. The composition of any one of embodiments 1-6, wherein the one or more microbes are selected from species of the following genera: *Pseudomonas, Kosakonia, Bacillus, Azospirillum, Candida, Saccharomyces*, and *Agrobacterium.*
8. The composition of embodiment 1, wherein the one or more microbes is *Kosakonia sacchari.*
9. The composition of embodiment 1, wherein the one or more isolated bacteria is from the genus *Klebsiella* and the one or more microbes is from the genus *Kosakonia.*
10. The composition of embodiment 1, wherein the one or more isolated bacteria is *Klebsiella variicola* and the one or more microbes is *Kosakonia sacchari.*
11. The composition of embodiment 1, wherein the one or more isolated bacteria is *Klebsiella variicola* 137-1036 strain and the one or more microbes is *Kosakonia sacchari.*
12. The composition of any one of embodiments 1-11, wherein the one or more isolated bacteria is capable of fixing atmospheric nitrogen.
13. The composition of any one of embodiments 1-12, wherein the one or more biofilms comprises two biofilms produced by two different microbes.
14. The composition of any one of embodiments 1-13, wherein the viability of the one or more isolated bacteria exhibit an increase of at least 5% when stored for at least 30 days, as compared to a control composition comprising one or more isolated bacteria lacking the one or more biofilms.
15. The composition of any one of embodiments 1-14. wherein the viability of the one or more isolated bacteria exhibit an increase of at least 25%, as compared to a control composition comprising one or more isolated bacteria and lacking the one or more biofilms.
16. The composition of any one of embodiments 1-15, wherein the viability of the one or more isolated bacteria exhibit an increase in viability when stored in liquid culture for at least 90 days.
17. The composition of any one of embodiments 1-16, wherein the composition is a solid.
18. The composition of any one of embodiments 1-16, wherein the composition is a liquid.
19. The composition of any one of embodiments 1-18, wherein the composition is a seed coat present on a plant seed.
20. The composition of any one of embodiments 1-16, wherein the composition is a semi-solid.
21. The composition of any one of embodiments 1-20, wherein the one or more isolated bacteria are endophytic, epiphytic, or rhizospheric.
22. The composition of any one of embodiments 1-21, wherein the one or more isolated bacteria are wild type bacteria.
23. The composition of any one of embodiments 1-21, wherein the one or more isolated bacteria are transgenic bacteria.
24. The composition of any one of embodiments 1-21. wherein the one or more isolated bacteria are non-intergeneric remodeled bacteria.

25. The composition of embodiment 24, wherein the non-intergeneric remodeled bacteria are derived from, or comprise, a bacterium selected from Table 1.
26. The composition of embodiment 24, wherein the non-intergeneric remodeled bacteria are capable of fixing atmospheric nitrogen in the presence of exogenous nitrogen.
27. The composition of embodiment 24, wherein the non-intergeneric remodeled bacteria comprise at least one genetic variation introduced into at least one gene, or non-coding polynucleotide, of the nitrogen fixation or assimilation genetic regulatory network.
28. The composition of any one of embodiments 1-27, wherein each of the one or more isolated bacteria comprises an introduced control sequence operably linked to at least one gene of the nitrogen fixation or assimilation genetic regulatory network.
29. The composition of any one of embodiments 1-28, wherein each of the one or more isolated bacteria comprises a heterologous promoter operably linked to at least one gene of the nitrogen fixation or assimilation genetic regulatory network.
30. The composition of any one of embodiments 1-29, wherein each of the one or more isolated bacteria comprises at least one genetic variation introduced into a member selected from the group consisting of: nifA, nifL, ntrB, ntrC, polynucleotide encoding glutamine synthetase, glnA, glnB, glnK drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.
31. The composition of any one of embodiments 1-30, wherein each of the one or more isolated bacteria comprises at least one genetic variation introduced into at least one gene, or non-coding polynucleotide, of the nitrogen fixation or assimilation genetic regulatory network that results in one or more of: increased expression or activity of NifA or glutaminase; decreased expression or activity of NifL, NtrB, glutamine synthetase, GlnB, GlnK, DraT, AmtB; decreased adenylyl-removing activity of GlnE, or decreased uridylyl-removing activity of GlnD.
32. The composition of any one of embodiments 1-31, wherein each member of the one or more isolated bacteria comprises a mutated nifL gene that comprises a heterologous promoter in said nifL gene.
33. The composition of any one of embodiments 1-32, wherein each of the one or more isolated bacteria comprises a mutated glnE gene that results in a truncated GlnE protein lacking an adenylyl-removing (AR) domain.
34. The composition of any one of embodiments 1-33, wherein each of the one or more isolated bacteria comprises a mutated amtB gene that results in the lack of expression of said amtB gene.
35. The composition of any one of embodiments 1-34, wherein each of the one or more isolated bacteria comprises at least one of: a mutated nifL gene that comprises a heterologous promoter in said nifL gene; a mutated glnE gene that results in a truncated GlnE protein lacking an adenylyl-removing (AR) domain; a mutated amtB gene that results in the lack of expression of said amtB gene; and combinations thereof.
36. The composition of any one of embodiments 1-35, wherein each of the one or more isolated bacteria comprises a mutated nifL gene that comprises a heterologous promoter in said nifL gene and a mutated glnE gene that results in a truncated GlnE protein lacking an adenylyl-removing (AR) domain.
37. The composition of any one of embodiments 1-36, wherein each of the one or more isolated bacteria comprises a mutated nifL gene that comprises a heterologous promoter in said nifL gene, a mutated glnE gene that results in a truncated GlnE protein lacking an adenylyl-removing (AR) domain, and a mutated amtB gene that results in the lack of expression of said amtB gene.
38. The composition of any one of embodiments 1-37, wherein each of the one or more isolated bacteria comprises at least one genetic variation introduced into genes involved in a pathway selected from the group consisting of: exopolysaccharide production, endo-polygalaturonase production, trehalose production, and glutamine conversion.
39. The composition of any one of embodiments 1-38, wherein each of the one or more isolated bacteria comprises at least one genetic variation introduced into genes selected from the group consisting of: bcsii, bcsiii, yjbE, fhaB, pehA, otsB, treZ, glsA2, and combinations thereof.
40. The composition of any one of embodiments 1-39. wherein the one or more isolated bacteria comprises bacteria selected from: a bacterium deposited as NCMA 201701002, a bacterium deposited as NCMA 201708004, a bacterium deposited as NCMA 201708003, a bacterium deposited as NCMA 201708002, a bacterium deposited as NCMA 201712001, a bacterium deposited as NCMA 201712002, and combinations thereof.
41. The composition of any one of embodiments 1-40, wherein the one or more isolated bacteria comprises bacteria comprising a nucleic acid sequence that shares at least about 90%, 95%, or 99% sequence identity to a nucleic acid sequence selected from SEQ ID NOs: 177 260, 296-303, and 458-469.
42. The composition of any one of embodiments 1-40. wherein the one or more isolated bacteria comprises bacteria with a nucleic acid sequence selected from SEQ ID NOs: 177-260, 296-303, and 458-469.
43. A method for increasing the viability of a bacterial composition, the method comprising, combining:
(i) one or more isolated bacteria, and
(ii) one or more biofilms produced by one or more microbes;

wherein the one or more biofilms are exogenous to the one or more isolated bacteria, and wherein the increase in viability is relative to a control composition comprising one or more isolated bacteria lacking the one or more biofilms.

44. The method of embodiment 43, wherein the one or more isolated bacteria are selected from the following genera: *Achromobacter, Agrobacterium, Anabaena, Azorhizobium, Azospirillum, Azotobacter, Bacillus, Bradyrhizobium, Candida, Clostridium, Enterobacter, Klebsiella, Kluyvera, Kosakonia, Mesorhizobium, Alicrobacterium, Pseudomonas, Rahnella, Rhizobium, Saccharomyces*, and *Sinorhizobium.*
45. The method of embodiment 43 or 44, wherein the one or more isolated bacteria are selected from: *Achromobacter marplatensis, Achromobacter spiritinus, Azospirillum lipofenim, Enterohacter* sp., *Klebsiella variicola, Kluyvera intermedia, Kosakonia pseudosacchari, Kosakonia sacchari, Microbacterium murale, Rahnella aquatilis*, and combinations thereof.
46. The method of embodiment 43, wherein the one or more isolated bacteria is from the genus *Klebsiella.*
47. The method of embodiment 43, wherein the one or more isolated bacteria is a *Klebsiella variicola.*
48. The method of embodiment 43, wherein the one or more isolated bacteria is a *Klebsiella variicola* 137-1036 strain.

49. The method of any one of embodiments 43-48, wherein the one or more microbes are selected from species of the following genera: *Pseudomonas, Kosakonia, Bacillus, Azospirillum, Candida, Saccharomyces*, and *Agrobacterium.*
50. The method of embodiment 43, wherein the one or more microbes is *Kosakonia sacchari.*
51. The method of embodiment 43, wherein the one or more isolated bacteria is from the genus *Klebsiella* and the one or more microbes is from the genus *Kosakonia.*
52. The method of embodiment 43, wherein the one or more isolated bacteria is *Klebsiella variicola* and the one or more microbes is *Kosakonia sacchari.*
53. The method of embodiment 43, wherein the one or more isolated bacteria is *Klebsiella variicola* 137-1036 strain and the one or more microbes is *Kosakonia sacchari.*
54. The method of any one of embodiments 43-53, wherein the one or more isolated bacteria is capable of fixing atmospheric nitrogen.
55. The method of any one of embodiments 43-54, wherein the one or more biofilms comprises two biofilms produced by two different microbes.
56. The method of any one of embodiments 43-55, wherein the viability of the one or more isolated bacteria exhibit an increase of at least 5% when stored for at least 30 days, as compared to a control composition comprising one or more isolated bacteria and lacking the one or more biofilms.
57. The method of any one of embodiments 43-56, wherein the viability of the one or more isolated bacteria exhibit an increase of at least 25%, as compared to a control composition comprising one or more isolated bacteria and lacking the one or more biofilms.
58. The method of any one of embodiments 43-57, wherein the viability of the one or more isolated bacteria exhibit an increase in viability when stored in liquid culture for at least 90 days.
59. The method of any one of embodiments 43-58, wherein the composition is a solid.
60. The method of any one of embodiments 43-58, wherein the composition is a liquid.
61. The method of any one of embodiments 43-60, wherein the composition is a seed coat present on a plant seed.
62. The method of any one of embodiments 43-58, wherein the composition is a semi-solid.
63. The method of any one of embodiments 43-62, wherein the one or more isolated bacteria are endophytic, epiphytic, or rhizospheric.
64. The method of any one of embodiments 43-63, wherein the one or more isolated bacteria are wild type bacteria.
65. The method of any one of embodiments 43-63, wherein the one or more isolated bacteria are transgenic bacteria.
66. The method of any one of embodiments 43-63, wherein the one or more isolated bacteria are non-intergeneric remodeled bacteria.
67. The method of embodiment 66, wherein the non-intergeneric remodeled bacteria are derived from, or comprise, a bacterium selected from Table 1.
68. The method of embodiment 66, wherein the non-intergeneric remodeled bacteria comprises at least one genetic variation introduced into at least one gene, or non-coding polynucleotide, of the nitrogen fixation or assimilation genetic regulatory network, such that the modified bacterium is capable of fixing atmospheric nitrogen in the presence of exogenous nitrogen.
69. The method of embodiment 54. wherein the one or more isolated bacteria produce 1% or more of the fixed nitrogen in a plant exposed thereto.
70. The method of any one of embodiments 43-69, wherein the one or more isolated bacteria are capable of fixing atmospheric nitrogen in the presence of exogenous nitrogen.
71. The method of any one of embodiments 43-70, wherein each of the one or more isolated bacteria comprises at least one genetic variation introduced into at least one gene, or non-coding polynucleotide, of the nitrogen fixation or assimilation genetic regulatory network.
72. The method of any one of embodiments 43-71, wherein each of the one or more isolated bacteria comprises an introduced control sequence operably linked to at least one gene of the nitrogen fixation or assimilation genetic regulatory network.
73. The method of any one of embodiments 43-72, wherein each of the one or more isolated bacteria comprises a heterologous promoter operably linked to at least one gene of the nitrogen fixation or assimilation genetic regulatory network.
74. The method of any one of embodiments 43-73, wherein each member of the one or more isolated bacteria comprises at least one genetic variation introduced into a member selected from the group consisting of: nifA, nifL, ntrB, ntrC, polynucleotide encoding glutamine synthetase, glnA, glnB, glnK, drat, amtB, polynucleotide encoding glutaminase, glnD, glnE, nifJ, nifH, nifD, nifK, nifY, nifE, nifN, nifU, nifS, nifV, nifW, nifZ, nifM, nifF, nifB, nifQ, a gene associated with biosynthesis of a nitrogenase enzyme, and combinations thereof.
75. The method of any one of embodiments 43-74, wherein each member of the one or more isolated bacteria comprises at least one genetic variation introduced into at least one gene, or non-coding polynucleotide, of the nitrogen fixation or assimilation genetic regulatory network that results in one or more of: increased expression or activity of NifA or glutaminase; decreased expression or activity of NifL, NtrB, glutamine synthetase, GlnB, GlnK, DraT. AmtB; decreased adenylyl-removing activity of GlnE; or decreased uridylyl-removing activity of GlnD.
76. The method of any one of embodiments 43-75, wherein each member of the one or more isolated bacteria comprises a mutated nifL gene that comprises a heterologous promoter in said nifL gene.
77. The method of any one of embodiments 43-76, wherein each member of the one or more isolated bacteria comprises a mutated glnE gene that results in a truncated GlnE protein lacking an adenylyl-removing (AR) domain.
78. The method of any one of embodiments 43-77, wherein each member of the one or more isolated bacteria comprises a mutated amtB gene that results in the lack of expression of said amtB gene.
79. The method of any one of embodiments 43-78, wherein each member of the one or more isolated bacteria comprises at least one of: a mutated nifL gene that comprises a heterologous promoter in said nifL gene; a mutated glnE gene that results in a truncated GlnE protein lacking an adenylyl-removing (AR) domain; a mutated amtB gene that results in the lack of expression of said amtB gene; and combinations thereof.
80. The method of any one of embodiments 43-79, wherein each member of the one or more isolated bacteria comprises a mutated nifL gene that comprises a heterologous promoter in said nifL gene and a mutated glnE gene that results in a truncated GlnE protein lacking an adenylyl-removing (AR) domain.
81. The method of any one of embodiments 43-80, wherein each member of the one or more isolated bacteria comprises a mutated nifL gene that comprises a heterologous promoter in said nifL gene, a mutated glnE gene that results in a truncated GlnE protein lacking an adenylyl-removing (AR) domain, and a mutated amtB gene that results in the lack of expression of said amtB gene.

82. The method of any one of embodiments 43-81, wherein each of the one or more isolated bacteria comprises at least one genetic variation introduced into genes involved in a pathway selected from the group consisting of: exopolysaccharide production, endo-polygalaturonase production, trehalose production, and glutamine conversion.

83. The method of any one of embodiments 43-82, wherein each of the one or more isolated bacteria comprises at least one genetic variation introduced into genes selected from the group consisting of: bcsii, bcsiii, yjbE, fhaB, pehA, otsB, treZ, glsA2, and combinations thereof.

84. The method of any one of embodiments 43-83, wherein the one or more isolated bacteria comprise bacteria selected from: a bacterium deposited as NCMA 201701002, a bacterium deposited as NCMA 201708004, a bacterium deposited as NCMA 201708003, a bacterium deposited as NCMA 201708002, a bacterium deposited as NCMA 201712001, a bacterium deposited as NCMA 201712002, and combinations thereof.

85. The method of any one of embodiments 43-84, wherein the one or more isolated bacteria comprise bacteria comprising a nucleic acid sequence that shares at least about 90%, 95%, or 99% sequence identity with a nucleic acid sequence selected from SEQ ID NOs: 177-260, 296 303, and 458-469.

86. The method of any one of embodiments 43-84, wherein the one or more isolated bacteria comprise bacteria comprising a nucleic acid sequence selected from SEQ ID NOs: 177-260, 296-303, and 458-469.

87. The composition of any one of embodiments 1-42, wherein the viability of the one or more isolated bacteria exhibit an increase of at least 5% when stored at 37° C., compared to a control composition comprising the one or more isolated bacteria and lacking the one or more biofilms stored under the same conditions.

88. The composition of any one of embodiments 1-42, wherein the viability of the one or more isolated bacteria exhibit an increase of at least 5% when stored at 37° C. for 1 week, compared to a control composition comprising the one or more isolated bacteria and lacking the one or more biofilms stored under the same conditions.

89. The composition of any one of embodiments 1-42, wherein the viability of the one or more isolated bacteria exhibit an increase of at least 5% when stored at 37° C. for 2 weeks, compared to a control composition comprising the one or more isolated bacteria and lacking the one or more biofilms stored under the same conditions.

90. The method of any one of embodiments 43-86, wherein the viability of the one or more isolated bacteria exhibit an increase of at least 5% when stored at 37° C., compared to a control composition comprising the one or more isolated bacteria and lacking the one or more biofilms stored under the same conditions.

91. The method of any one of embodiments 43-86, wherein the viability of the one or more isolated bacteria exhibit an increase of at least 5% when stored at 37° C. for 1 week, compared to a control composition comprising the one or more isolated bacteria and lacking the one or more biofilms stored under the same conditions.

92. The method of any one of embodiments 43-86, wherein the viability of the one or more isolated bacteria exhibit an increase of at least 5% when stored at 37° C. for 2 weeks, compared to a control composition comprising the one or more isolated bacteria and lacking the one or more biofilms stored under the same conditions.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that they constitute valid prior art or form part of the common general knowledge in any country in the world. Further, U.S. Pat. No. 9,975,817, issued on May 22, 2018. and entitled: *Methods and Compositions for Improving Plant Traits*, is hereby incorporated by reference. Further, PCT/US2018/013671, filed Jan. 12, 2018, published as WO02018132774A1 on Jul. 19, 2018, and entitled: *Methods and Compositions for Improving Plant Traits*, is hereby incorporated by reference.

---

SEQUENCE LISTING (469 sequences)

SEQ ID NO: 1 - protein, 9 aa, Unknown
  "LAGLIDADG" family peptide motif sequence
LAGLIDADG

SEQ ID NO: 2 - DNA, 90 bp, Artificial Sequence
  Synthetic oligonucleotide
gttgatcagaccgatgttcggaccttccaaggtttcgatcggacatacgcgaccgtagtgggtcgggtgtacgtctcgaacttcaaagcc

SEQ ID NO: 3 - DNA, 257 bp, Artificial Sequence
  Synthetic polynucleotide
gcctctcggggcgcttttttttattccggcactagccgctattaataaaaatgcaaatcggaatttactatttaacgcgagattatctaagatgaatccgatggaagcgcgctgttttcactcgcctttttaaagttacgtgatgatttcgatgcttctttgagcgaacgatcaaaaataagcgtattcaggtaaaaaaatattctcatcacaaaaaagtttgtgtaatacttgtaacgctacatggagattaactc

SEQ ID NO: 4 - DNA, 260 bp, Artificial Sequence
  Synthetic polynucleotide
ggttcacataaacataattatcgccacggcgatagccgtacgctttttgcgtcacaacatccatggtgaagccggctttttcaagaacacgcgccacctcatcgggtcttaaatacatactcattcctcattatcttttaccgcacgttaaccttaccttattcattaaaggcaacgctttcggaatattccataaagggctatttacagcataattcaaaatcttgtcctacacttatagactcaatggaattaaggga

SEQ ID NO: 5 - DNA, 260 bp, Artificial Sequence
  Synthetic polynucleotide
gcgcggaaaatcgacgcatagcgcattctcagaagccggcctggtctcggtggaaaagcgaatctttcccacgaccgccgggcctttaacaaaagaatcaatgacctgattaatgtcgctatccattctctctccgcgtaatgcgatcttttttcatcatacctaacaaactggcagagggaaaagccgcgcggtttttctgcgaagtgtattgtaagatttgtttgatatgttatatcgtaacatattattgcaaacat

SEQ ID NO: 6 - DNA, 259 bp, Artificial Sequence
  Synthetic polynucleotide
ctgacgaagcgagttacatcaccggtgaaactctgcacgtcaacggcggaatgtatatggtctgaccgagatttgcgcaaaacgctcaggaaccgcgcagtctgtgcggttcactgtaatgttttgtacaaaatgatttgcgttatgagggcaaacagccgcaaaatagcgtaaaatcgtggtaagacctgccgggatttagttgcaaatttttcaacattttatacactacgaaaaccatcgcgaaagcgagttttga

SEQ ID NO: 7 - DNA, 260 bp, Artificial Sequence
  Synthetic polynucleotide
acgcctggggcgccgaccagcgggaagagtgatttggccaacgaggcgccgctctgaatggaaatcatggcgattaaaataaccagtatcggcaaccatgccggtaccttacgagacgagccgggcatcctttctcctgtcaattttgtcaaatgcggtaaaggttccagtgtaattgaattaccccgcgccggttgagctaatgttgaaaaaaagggtcttaaaagcagtacaatagggcgggtctgaagataatttca

SEQ ID NO: 8 - DNA, 260 bp, Artificial Sequence
  Synthetic polynucleotide
tctgattcctgatgaaaataaacgcgaccttgaagaaattccggataacgttatcgccgatttagatatccatccggtgaaacgaatcgaggaagttctggcacttgcgctacagaacgaaccgtttggaatggaagtcgtcacggcaaaatagtgatttcgcgcaaatagcgctaagaaaaatagggctggtaagtaaattcgtacttgccagcctttttttgtgtagctaacttagatcgctggcaggggggtcaatt

SEQ ID NO: 9 - DNA, 259 bp, Artificial Sequence
  Synthetic polynucleotide
gtaagaaagtcggcctgcgtaaagcacgtcgtcgtcctcagttctccaaacgttaattgttttctgctcacgcagaacaatttgcgaaaaaacccgcttcggcgggtttttttatggataaatttgccattttccctctacaaacgccccattgttaccactttttcagcatttccagaatcccctcaccacaacgtcttcaaaatctggtaaactatcatccaattttctgcccaaatgcaggtgattgttcattttt

SEQ ID NO: 10 - DNA, 260 bp, Artificial Sequence
  Synthetic polynucleotide
gtcaaagccgtattatcgaccccttagggacaacgcttgccggggcgggagagcggccgcagttgatttttgccgaactttcagctgattatattcagcaggtacgcgagcgcctgccggtgttgcgcaatcgccgctttgcgccaccgcaattattatgacgtttttttaaacaaggcttgattcaccttgttacagattgctattgtgtccgcgcgtcaaatagccgttaattgtatgcgtgtatgatggcgtattcg

SEQ ID NO: 11 - DNA, 260 bp, Artificial Sequence
  Synthetic polynucleotide
gaggcggtggttgaccgtatcggtcccgagcatcatgagctttcggggcgagcgaaagatatgggatcggcggcggtactgctggcgattatcatcgcgctgatcgcgtggggaacgctgctgtgggcgaactaccgctaagtcttgtcgtagctgctcgcaaaacggaaagaaactcctgatttttgtgtgaaatgtggttccaaaatcaccgttagctgtatatactcacagcataactgtatatacacccagggggc

SEQ ID NO: 12 - DNA, 260 bp, Artificial Sequence
  Synthetic polynucleotide
taagaaaagcggcctgtacgaagacggcgtacgtaaagacaggctggataacgacgatatgatcgatcagctggaagcgcgtattcgcgctaaagcatcgatgctggatgaggcgcgtcgtatcgatatccagcaggttgaagcgaaataacgtgttgggaagcgatacgcttcccgtgtatgattgaacctgcgggcgcgaggcgccggggttcatttttgtatatataaagagaataaacgtggcaaagaacattcaa

SEQ ID NO: 13 - DNA, 237 bp, Artificial Sequence
  Synthetic polynucleotide
atgaatcgtactaaactggtactgggcgcggtaatcctgggttctactctgctggctggttgctccagcaatgctaaaatcgatcagctgtcttctgacgttcagactctgaacgctaaagttgaccagctgagcaacgacgtgaacgcaatgcgttccgacgttcaggctgctaaagatgacgcagctcgcgctaaccagcgtctggacaacgcagctactaaataccgtaagtaa

SEQ ID NO: 14 - DNA, 327 bp, Artificial Sequence
  Synthetic polynucleotide
atggccaaccgagcaaaccgcaacaacgtagaagagagcgctgaagatatccataacgatgtcagccaattagcggatacgctggaagaggtgctgaaatcgtggggcagcgacgccaaagacgaagcggaggccgcgcgcaaaaaagcgcaggcgctgctgaaagagacccgcgcccggcttaacggcaacaaccgcgtccagcaggcggcgtgcgacgccatgggctgcgctgacagctacgtgcgcgacaaaccgtggcaaagcgtcggcgccgcagcagccgttggggtatttattggcgtattactgaatttacgtcgataa

SEQ ID NO: 15 - DNA, 648 bp, Artificial Sequence
  Synthetic polynucleotide
atgaccaaaaagatttccgccctagcgtttggcattggcatggtaatggcgagcagccaggcttttgcccacggtcaccatagtcatggcccggcgctgaccgaagcggaacaaaaggcgagtgaaggcatttttgctgaccaggacgtaaaggacagggcgctgagcgactgggaggggatctggcagtcggttaacccctatctgctgaacggggatttagatccggttctggagcagaaggccaaaaaggccggtaaaagcgtggcggaatatcgggaatattataagaagggctacgctaccgatgtcgaccagattggtatcgaggataacgtcatggagtttcacgtcgggaaaaccgtcaacgcctgtaagtacagctattccggttacaaaattctgacctacgcatccggtaaaaaaggcgtgcgctacctgttcgaatgccagcaggcggattcaaaagcgccgaagtttgttcagtttagcgatcacaccatcgcgccacgcaagtcccagcatttccacatctttatgggcaatgagtcccaggaagcgctgctgaaagagatggataactggccaacctactatccttatgcgctgcataaagagcagattgtcgacgaaatgctgcaccactaa

SEQ ID NO: 16 - DNA, 237 bp, Artificial Sequence
  Synthetic polynucleotide
atgagcactatcgaagaacgcgttaagaaaattatcggcgaacagctgggcgttaagcaggaagaagttaccaacaatgcttccttcgttgaagacctgggcgctgattctcttgacaccgttgagctggtaatggctctggaagaagagtttgatactgagattccggacgaagaagctgagaaaatcactactgttcaggctgccattgattacatcaacggccaccaggcgtaa

SEQ ID NO: 17 - DNA, 513 bp, Artificial Sequence
  Synthetic polynucleotide
atgaataaaattgcacgtttttcagcactggccgttgttctggctgcatccgtaggtaccactgctttcgctgcgacttctaccgttaccggtggctacgcgcagagcgacatgcagggtgaagcgaacaaagctggcggtttcaacctgaagtaccgctacgagcaagacaacaacccgctgggtgttatcggttctttcacctacaccgaaaaagatcgttctgaatctggcgtttacaaaaaaggccagtactacggcatcaccgcaggtccggcttaccgtctgaacgactgggctagcatctacggcgtagtgggtgttggttacggtaaattccaggacaacagctacccgaacaaatctgatatgagcgactacggtttctcttacggcgctggtctgcagttcaacccgatcgaaaacgttgccctggacttctcctacgagcagtctcgcattcgtaacgttgacgttggcacctggattgctggcgtaggttaccgcttctaa

SEQ ID NO: 18 - DNA, 273 bp, Artificial Sequence
  Synthetic polynucleotide
gtgaataaatctcaactgattgacaaaattgctgccggtgcggacatttctaaagccgcagctggacgtgcgttagatgctttaatcgcttctgttactgaatctctgcaggctggagatgacgttgcgctggtagggtttggtacttttgctgttaaagagcgcgctgcccgtactggtcgcaatccgcaaacaggcaaagaaatcaccattgctgctgctaaagttccgggtttccgcgcaggtaaagcgctgaaagacgcggtaaactga

SEQ ID NO: 19 - DNA, 639 bp, Artificial Sequence
  Synthetic polynucleotide
atggctgtcgctgccaacaaacgttcggtaatgacgctgttttctggtcctactgacatctatagccatcaggtccgcatcgtgctggccgaaaaaggtgttagttttgagatagagcacgtggagaaggacaacccgcctcaggatctgattgacctcaacccgaatcaaagcgtaccgacgcttgtggatcgtgagctcactctgtgggaatctcgcatcattatggaatatctggatgagcgtttcccgcatccgccgctcatgccggtttacccggtggcgcgtggggaaagccgtctgtatatgcagcgtatcgaaaaggactggtattcgttgatgaataccattcagaccggtaccgctgcgcaggctgatactgcgcgtaagcagctgcgtgaagaactacaggcgattgcgccagttttcacccagaagccctacttcctgagcgatgagttcagcctggtggactgctacctggcaccactgctgtggcgtctgccggttctcggcgtagagctggtcggcgctggcgcgaaagagcttaaaggctatatgactcgcgtatttgagcgcgactctttcctcgcttctttaactgaagccgaacgtgaaatgcgtctcggtcggggctaa

SEQ ID NO: 20 - DNA, 204 bp, Artificial Sequence
  Synthetic polynucleotide
atgggtgagattagtattaccaaactgctggtagtcgcagcgctgattatcctggtgtttggtaccaaaaagttacgcacgctgggtggagacctgggctcggctatcaaaggctttaaaaaagccatgagcgatgacgatgacagtgcgaagaagaccagtgctgaagaagcgccggcacagaagctctctcataaagagtaa

SEQ ID NO: 21 - DNA, 609 bp, Artificial Sequence
  Synthetic polynucleotide
atgaaagcgttaacgaccaggcagcaagaggtgtttgatctcattcgggatcatatcagccagacgggcatgccgccgacgcgtgcggagattgctcagcgcttggggtttcgctccccaaacgcggcggaagagcatctgaaagcgctggcgcgtaaaggcgcaatcgagatcgtttccggcgcctcccgcggtattcgtctgctgacggaagaagaaaccggtctgccgcttattggccgcgtcgcggcaggtgagccgctgctagcgcagcagcacattgaaggccactaccaggtggacccggccatgtttaagccgaacgccgattttctgctgcgtgttagcggtatgtcgatgaaggatatcggtattctcgatggcgacctgctggctgtccataaaacgcaggatgtgcgcaatggtcaggtggttgtggcgcgtatcgacgaagaagtgaccgtgaagcgtctgaaaaaacagggtaacgtcgtggaattgctgccggaaaacagcgaattctcgccgatcgtggtcgaccttcgcgaacaaagctttactattgaaggcctggccgtcggcgttatccgcaacggcaactggcaataa

SEQ ID NO: 22 - DNA, 1245 bp, Artificial Sequence
  Synthetic polynucleotide
atgaacgattatctgccgggcgaaaccgctctctggcagcgcattgaaggctcactgaagcaggtgcttggtagctacggttacagcgaaatccgtttgccgattgtagagcagaccccgttattcaaacgcgctatcggcgaagtgaccgacgtggttgaaaaagagatgtacacctttgaggaccgtaacggcgatagcctgactctacgtccggaaggcacggctggctgcgtacgcgccggtatcgaacatggtctcctgtacaatcaagaacagcgcctgtggtacattgggccgatgttccgccacgaacgtccgcaaaaaggccgctaccgtcagttccaccagattggcgccgaagcgtttggcctgcaggggccggatatcgatgccgagctgattatgctgaccgcccgctggtggcgcgagctgggcatctccggccacgttgcgctggagctgaactctatcggttcgctggaggctcgcgctaactatcgcgacgcgctggtggcctatcttgagcagtttaaagataagctggacgaagactgcaaacgccgcatgtacaccaacccgctgcgcgtgctggattctaaaaacccggacgtccaggcgctgctgaacgacgccccgacgctgggcgactatcttgatgaagagtccaaaacgcattttgccgggctgtgcgcgctgctggatgatgccggtattcgctataccgtgaatcagcgtctggtacgcggtctcgactactacaaccgcaccgtgtttgagtgggtcaccaccagcctcggttcccagggcaccgtctgcgccggaggccgttacgatggtctggttgagcagcttggcggtcgcgctacccctggcgtcggctttgcgatggggctggaacgtcttgttttactggttcaggcagtgaatccggaatttaaagccgatcctgttgtcgatatatacctggtagcctccggaactgacacccagtccgcagcaatgcgtctggctgaacaggtacgcgatgcgttacccggcgttaagctgatgaccaaccatggcggcggcaactttaagaagcagtttgcgcgcgctgataaatggggcgctcgcgttgcgctggtgctgggcgaatcagaaatcgccgacggaaacgtggtagtgaaagatttacgctcaggtgagcaaactaccgtaacgcaggatagcgttgctgcgcatttgcgcacacttctgggttaa

SEQ ID NO: 23 - DNA, 1413 bp, Artificial Sequence
  Synthetic polynucleotide
atgaaaaagaccaaaattgtttgcaccatcggtccgaaaaccgaatccgaagagatgttgaccaaaatgctggacgcgggcatgaacgttatgcgtctgaacttctctcacggtgactatgcggaacacggtcagcgcatccagaatctgcgcaatgtgatgagtaaaaccggtaagaaagcggcaatcctgctggacaccaaaggtccggaaatccgtaccattaagctggaaggcggcaacgacgtctccctgaaagcgggccagaccttcaccttcaccaccgataaatccgttgtcggtaataacgaaatcgttgcggtgacctatgaaggcttcaccagcgacctgagcgttggcaacacggtactggttgacgatggtctgatcggtatggaagtgaccgctatcgaaggcaacaaagttgtttgtaaagtgctgaacaacggcgacctcggcgagaacaaaggcgttaacctgccgggcgtatctatcgcgctgccggcgctggctgaaaaagacaaacaggatctgatcttcggttgcgaacagggcgttgactttgttgcggcatcctttatccgtaagcgttctgacgttgttgaaatccgtgagcacctgaaagcccacggcggcgagaagatccagatcatctccaaaatcgaaaaccaggaaggcctgaacaacttcgacgaaatcctcgaagcctctgacggcatcatggtagcccgtggcgacctgggcgttgaaatcccggttgaagaagttatcttcgcgcagaagatgatgatcgagaaatgtatccgcgcgcgtaaagtcgttatcaccgcgacccagatgctggattccatgatcaaaaacccgcgtccgacccgtgcggaagcaggcgacgtggccaacgccatcctcgacggcaccgacgcagttatgctgtccggcgaatccgcgaaaggtaaatacccgctggaagcggtcaccatcatggcgaccatctgcgaacgtaccgaccgcgtcatgaccagccgtcttgagtacaacaacgacaaccgtaagctgcgcatcaccgaagcggtgtgccgcggtgcggtagaaacggctgaaaaactggaagcgccgctgatcgttgtggcaacccagggcggtaaatccgcgcgcgccgtacgtaaatacttcccggatgccactatcctggcgctgaccaccaacgaaaccaccgcgcgtcagctggtgctgagcaaaggcgttgtggcacagctggttgaagatatctcctctaccgatgcgttctacatccagggtaaagaactggcgctgcagagcggtctggcgcgtaaaggcgacgtggttgttatggtttccggcgcgttagtcccgagcggaaccaccaataccgcttccgtgcacgtgctgtaa

SEQ ID NO: 24 - DNA, 351 bp, Artificial Sequence
  Synthetic polynucleotide
atgtatttaagacccgatgaggtggcgcgtgttcttgaaaaagccggcttcaccatggatgttgtgacgcaaaaagcgtacggctatcgccgtggcgataattatgtttatgtgaaccgtgaagctcgtatggggcgtaccgcgttaattattcatccggctttaaaagagcgcagcacaacgcttgcggagcccgcgtcggatatcaaaacctgcgatcattatgagcagttcccgctctatttagcgggggatgctcaacagcattatggtattccacacgggttcagttcgcgaatggcgcttgagcgttttctgagtggcctgtttggcgaaacgcagtatagctga

SEQ ID NO: 25 - DNA, 864 bp, Artificial Sequence
  Synthetic polynucleotide
atggatagcgacattaatcaggtcattgattcttttgttaaaggcccggcggtcgtgggaaagattcgcttttccaccgagaccaggccggcttctgagaatgcgctatgcgtcgattttccgcgcctcgaaatcatgcttgcgggtcagcttcacgatccggcgattaaagccgatcgcgcccagctcatgccgcacgatgtgctgtatattcccgctggcggatggaatgacccgcaatggctggcgccctccactctgctcactatcttatttggtaaacagcagctggaattcgtcctgcgccactgggacggcagcgcgcttaacgtgctggataaacagcaggttccgcgccgcggtccccgggtcggctcttttctgctgcaggcgctgaatgaaatgcagatgcagccgcgggagcagcacacggcccgctttattgtcaccagcctgctcagccactgtgccgatctgctgggcagccaggtacaaacctcatcgcgcagccaggcgctttttgaagcgattcgtaagcatattgacgcccactttgccgacccgttaacccgggagtcggtggcgcaggcgttttacctctcgccaaactatctatcccacctgttccagaaatgcgggccaatgggctttaacgagtatctgaatcacatccgcctggagcaggccagaatgctgttaaaaggccacgatatgaaagtgaaagatatcgcccacgcctgcggtttcgccgacagcaactacttctgccgcctgtttcgcaaaaacaccgaacgctcgccgtcggagtatcgccgtcaatatcacagccagctgacggaaaaaacagccccggcaaaaaactag

SEQ ID NO: 26 - DNA, 735 bp, Artificial Sequence
  Synthetic polynucleotide
atgagttttgaaggaaaaatcgcgctggttaccggtgcaagtcgcgggattggccgcgcaatcgctgaaacgctcgttgcccgtggcgcgaaagttatcgggactgcgaccagcgaaagcggcgcgcaggcgatcagcgattatttaggtgctaacggtaaaggtctgctgctgaatgtgaccgatcctgcatctattgaatctgttctgggaaatattcgcgcagaatttggtgaagttgatatcctggtgaacaatgccgggatcactcgtgataacctgttaatgcgcatgaaagatgatgagtggaacgatattatcgaaaccaacctgtcatctgttttccgtctgtcaaaagcggtaatgcgcgctatgatgaaaaagcgtcatggacgtattatcactatcggttctgtggttggtaccatgggaaatgcgggtcaggccaactacgctgcggcgaaagcgggtctgattggcttcagtaaatcactggctcgcgaagttgcgtcccgcggtattactgtaaacgttgttgctccgggctttattgaaacggacatgacgcgtgcgctgaccgatgagcagcgtgcgggtacgctggcggcagttcctgcggggcgcctcggctctccaaatgaaatcgccagtgcggtggcatttttagcctctgacgaagcgagttacatcaccggtgaaactctgcacgtcaacggcggaatgtatatggtctga

SEQ ID NO: 27 - DNA, 71 bp, Artificial Sequence
  Synthetic oligonucleotide
atgcccggctcgtctcgtaaggtaccggcatggttgccgatactggttattttaatcgccatgatttccat

SEQ ID NO: 28 - DNA, 2355 bp, Artificial Sequence
  Synthetic polynucleotide
atgaatcctgagcgttctgaacgcattgaaatccccgtattgccgttgcgcgatgtggtggtttatccgcacatggtcatacccctgtttgtagggcgggaaaaatctatccgttgtctcgaagcagccatggaccatgataaaaaaatcatgctggttgcgcagaaagaagcctcgacggatgagccgggtgtaaacgatcttttcaccgtcgggaccgtggcgtctattttgcaaatgctgaagctaccggacggtactgttaaagtgctggtcgaaggtttgcagcgcgcgcgcatctctgcgctgtctgataatggcgaacatttttcggcgaaggcggaataccttgaatcgccggcgattgacgaacgcgagcaggaagtgctggttcgtaccgctatcagccagtttgaaggctacatcaagctgaacaaaaaaatccctccggaagtgctgacgtcgctgaatagcatcgacgatccggcgcgtctggcggataccatcgctgcgcatatgccgctgaagctggcggacaaacagtccgtgctggagatgtccgacgttaacgagcgtctggaatatctgatggcgatgatggagtcggaaatcgatctgctgcaggtggagaagcgtattcgcaaccgcgtgaaaaagcagatggagaaatctcagcgcgagtactatctgaatgagcaaatgaaagccattcaaaaagagctcggcgagatggacgacgccccggacgagaacgaagcgctgaagcgtaagatcgacgcggcgaaaatgccgaaagaggcaaaagagaaaaccgaagcggaactgcaaaaactgaaaatgatgtccccgatgtcggcggaagcgaccgtcgttcgcggctacatcgactggatggtgcaggtaccgtggaacgctcgcagcaaggttaaaaaagacctgcgtcaggctcaggagatcctcgataccgatcactacggccttgagcgcgtgaaggatcgcattcttgagtacctcgcggtgcagagccgtgttaacaagctcaaagggccgatcctgtgcctggttgggcctccgggggtaggtaaaacctctctcggccaatccatcgccaaagcaactggacgcaaatatgtgcgtatggcgctgggcggcgtgcgtgatgaagcggaaatccgcggtcaccgccgtacctatattggctcaatgccgggcaaactgatccagaaaatggctaaagtgggcgttaaaaacccgctgttcttgctggatgagatcgacaagatgtcttctgacatgcgcggcgatccggcctcggcgctgctggaggtgttggatccggaacagaacgtggcctttaacgaccactatctggaagtggattacgatctcagcgacgtgatgttcgttgcgacctctaactccatgaacatcccggcgccgctgctggatcgtatggaagtgatccgcctctccggctataccgaagatgagaagctaaacatcgccaaacgccatctgctgtcaaaacagattgagcgtaacgcgctcaagaaaggcgagctgacggtggatgacagcgcgattatcggcatcattcgctactacacccgtgaagcaggcgtgcgtggtctggagcgtgaaatctcgaaactgtgccgcaaagcggtgaaacagctgctgctggataagtcgctgaaacacatcgagattaacggcgacaacctgcacgatttccttggcgtgcagcgctacgactatggtcgtgcggatagcgaaaaccgcgtaggtcaggtgaccggactggcgtggacggaagtgggcggcgatctgctgaccattgaaaccgcctgcgttccgggtaaaggcaaactgacctacaccggttcactgggtgaagtcatgcaggaatccatccaggcggcgctgacggtggttcgttcacgtgcggataagctgggtattaactcagacttttacgaaaaacgtgatattcacgttcacgtgccggaaggcgcgacgccgaaggatggtccaagcgccggtatcgcgatgtgcaccgcgctggtttcctgtctgacgggtaatccggtacgcgccgacgtggcgatgaccggtgagattaccctccgtggccaggtattgccgattggtggtctgaaggaaaaactgttggccgcgcatcgcggcggcattaagactgttctgattcctgatgaaaataaacgcgaccttgaagaaattccggataacgttatcgccgatttagatatccatccggtgaaacgaatcgaggaagttctggcacttgcgctacagaacgaaccgtttggaatggaagtcgtcacggcaaaatag

SEQ ID NO: 29 - DNA, 393 bp, Artificial Sequence
  Synthetic polynucleotide
atggctgaaaatcaatactacggcaccggtcgccgcaaaagttccgcagctcgcgttttcatcaaaccgggcaacggtaaaatcgttatcaaccagcgttctctggaacagtacttcggtcgtgaaactgcccgcatggtagttcgtcagccgctggaactggtcgacatggttgagaaattagatctgtacatcaccgttaaaggtggtggtatctctggtcaggctggtgcgatccgtcacggtatcacccgcgctctgatggagtacgacgagtccctgcgtggcgaactgcgtaaagctggtttcgttactcgtgatgctcgtcaggttgaacgtaagaaagtcggcctgcgtaaagcacgtcgtcgtcctcagttctccaaacgttaa

SEQ ID NO: 30 - DNA, 789 bp, Artificial Sequence
  Synthetic polynucleotide
atgtttgttgctgccggacaatttgccgtaacgccggactggacgggaaacgcgcagacctgcgtcagcatgatgcgccaggccgcggagcggggggcgtcgcttctggttctgcctgaggcgttgctggcgcgagacgataacgatgcggatttatcggttaaatccgcccagcagctggatggcggcttcttacagctcttgctggcggagagcgaaaacagcgctttgacgacggtgctgaccctgcatatcccttccggcgaaggtcgagcgacgaatacgctggtggccctgcgtcaggggaagattgtggcgcaatatcagaaactgcatctctatgatgcgttcaatatccaggaatccaggctggtcgatgccgggcggcaaattccgccgctgatcgaagtcgacgggatgcgcgtcgggctgatgacctgctacgatttacgtttccctgagctggcgctgtcgttagcgctcagcggcgcgcagctcatagtgttgcctgccgcgtgggtaaaagggccgctgaaggaacatcactgggcgacgctgctggcggcgcgggcgctggatacaacctgctatattgtcgccgcaggagagtgcgggacgcgtaatatcggtcaaagccgtattatcgaccccttagggacaacgcttgccggggcgggagagcggccgcagttgatttttgccgaactttcagctgattatattcagcaggtacgcgagcgcctgccggtgttgcgcaatcgccgctttgcgccaccgcaattattatga

SEQ ID NO: 31 - DNA, 369 bp, Artificial Sequence
  Synthetic polynucleotide
atggccaataataccactgggttaacccgaattattaaagcggccgggtattcctggaaaggattccgtgcggcgtgggtcaatgaggccgcatttcgtcaggaaggcatcgcggccgttattgccgtggcgatcgcctgctggttggacgtcgatgccatcacgcgggtgctgctcattagctcggtcctgttagtgatgatagttgaaattatcaatagcgcgattgaggcggtggttgaccgtatcggtcccgagcatcatgagctttcggggcgagcgaaagatatgggatcggcggcggtactgctggcgattatcatcgcgctgatcgcgtggggaacgctgctgtgggcgaactaccgctaa

SEQ ID NO: 32 - DNA, 1122 bp, Artificial Sequence
  Synthetic polynucleotide
atgcataaccaggctccgattcaacgtagaaaatcaaaacgaatttacgttgggaatgtgccgattggcgatggcgcccccatcgccgtacagtcgatgacaaacacgcgcaccaccgatgtggcggcgacggtaaatcaaattaaagccctcgagcgcgttggcgcggatatcgtgcgcgtttcggtgccgacgatggatgcggcggaagcgttcaaacttatcaaacagcaggttaacgtcccgctggttgccgatatccacttcgattaccgcattgcgctgaaggtagcggaatacggcgttgattgcctgcgtattaacccgggcaatatcggcaacgaagagcgtatccgcatggtggtggactgcgctcgcgataaaaatattcctatccgtatcggggtaaacgccggttctctggaaaaagatctccaggaaaaatacggcgaaccgactccgcaggcgctgctggaatcggcaatgcgccatgttgatcatctcgatcgtctcaacttcgatcagtttaaagtcagcgtaaaagcctccgatgtgttcctcgcggttgaatcctatcgcctgttggcgaaacagatcgatcagcctctgcacctcgggatcaccgaagcgggcggcgcgcgcagcggcgcggtgaagtccgcgatcggcctcggcctgctgctgtctgaagggattggcgatacgctgcgcgtctctctggcggcggatcccgttgaagagatcaaagtgggcttcgatattctcaagtcgctgcgtattcgctctcgcgggatcaactttattgcctgcccgacctgttcacgtcaggagtttgacgttatcggtaccgttaacgcgctggagcagcgcctggaagatatcattacgccgatggatatttcgatcattggctgcgtggtaaacggtcccggcgaggcgctggtttccaccctcggcgtaaccggcggcaataagaaaagcggcctgtacgaagacggcgtacgtaaagacaggctggataacgacgatatgatcgatcagctggaagcgcgtattcgcgctaaagcatcgatgctggatgaggcgcgtcgtatcgatatccagcaggttgaagcgaaataa

SEQ ID NO: 33 - DNA, 876 bp, Artificial Sequence
  Synthetic polynucleotide
atgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagcctgcctggttctgcgtttcccgctctttaataccctgaccggaggtgagcaatga

SEQ ID NO: 34 - DNA, 1491 bp, Artificial Sequence
  Synthetic polynucleotide
atgagcatcacggcgttatcagcatcatttcctgaggggaatatcgccagccgcttgtcgctgcaacatccttcactgttttataccgtggttgaacaatcttcggtggcgagcgtgttgagtcatcctgactagctgagatgagggctcgccccctcgtcccgacacttccagatcgccatagcgcacagcgcctcgagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacataattgctcacagccaaactatcaggtcaagtctgcttttattatttttaagcgtgcataataagccctacacaaatggtacccgaccggtggtgaatttaatctcgctgacgtgtagacattcccttatccagacgctgatcgcccatcatcgcggttctttagatctctcggtccgccctgatggcggcaccttgctgacgttacgcctgccggtacagcaggttatcaccggaggcttaaaatga

SEQ ID NO: 35 - DNA, 1021 bp, Artificial Sequence
  Synthetic polynucleotide
ctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagccttgaccctacgattcccgctatttcattcactgaccggaggttcaaaatga

SEQ ID NO: 36 - DNA, 1071 bp, Artificial Sequence
  Synthetic polynucleotide
atgaagatagcaacaatgaaaacaggtctgggagcgttggctcttcttccctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagcctgtgaagggctggacgtaaacagccacggcgaaaacgcctacaacgcctga

SEQ ID NO: 37 - DNA, 1071 bp, Artificial Sequence
  Synthetic polynucleotide
atgaccctgaatatgatgctcgataacgccgtacccgaggcgattgccggctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagccttggttctgcgtttcccgctctttaataccctgaccggaggtgagcaatga

SEQ ID NO: 38 - DNA, 426 bp, Artificial Sequence
  Synthetic polynucleotide
atgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatga

SEQ ID NO: 39 - DNA, 446 bp, Artificial Sequence
  Synthetic polynucleotide
atgaccctgaatatgatgatggatgccggctcaccacggcgataaccataggttttcggcgtggccacatccatggtgaatcccactttttccagcacgcgcgccacttcatcgggtcttaaatacatagattttcctcgtcatctttccaaagcctcgccaccttacatgactgagcatggaccgtgactcagaaaattccacaaacgaacctgaaaggcgtgattgccgtctggccttaaaaattatggtctaaactaaaatttacatcgaaaacgagggaggatcctatgtttaacaaaccgaatcgccgtgacgtagatgaaggtgttgaggatattaaccacgatgttaaccagctcgaactcacttcacaccccgaagggggaagttgcctgaccctacgattcccgctatttcattcactgaccggaggttcaaaatga

SEQ ID NO: 40 - DNA, 452 bp, Artificial Sequence
  Synthetic polynucleotide
atgaccctgaatatgatgatggatgccggctgacgaggcaggttacatcactggtgaaaccctgcacgtcaatggcggaatgtatatggtttaaccacgatgaaaattatttgcgttattagggcgaaaggcctcaaaatagcgtaaaatcgtggtaagaactgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttccttcgttgaagacctgggcgctgattctcttgacaccgaactcacttcacaccccgaagggggaagttgcctgaccctacgattcccgctatttcattcactgaccggaggttcaaaatga

SEQ ID NO: 41 - DNA, 461 bp, Artificial Sequence
  Synthetic polynucleotide
atgaccctgaatatgatgatggatgccggccgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatga

SEQ ID NO: 42 - DNA, 463 bp, Artificial Sequence
  Synthetic polynucleotide
atgaccctgaatatgatgatggatgccggcatattgacaccatgacgcgcgtaatgctgattggttctgtgacgctggtaatgattgtcgaaattctgaacagtgccatcgaagccgtagtagaccgtattggtgcagaattccatgaactttccgggcgggcgaaggatatggggtcggcggcggtgctgatgtccatcctgctggcgatgtttacctggatcgcattactctggtcacattttcgataacgcttccagaattcgataacgccctggttttttgcttaaatttggttccaaaatcgcctttagctgtatatactcacagcataactgtatatacacccagggggcgggatgaaagcattaacggccaggaactcacttcacaccccgaagggggaagttgcctgaccctacgattcccgctatttcattcactgaccggaggttcaaaatga

SEQ ID NO: 43 - DNA, 428 bp, Artificial Sequence
  Synthetic polynucleotide
atgaccctgaatatgatgatggatgccggcatcatattgcgctccctggttatcatttgttactaaatgaaatgttataatataacaattataaataccacatcgctttcaattcaccagccaaatgagaggagcgccgtctgacatagccagcgctataaaacatagcattatctatatgtttatgattaataactgatttttgcgttttggatttggctgtggcatccttgccgctcttttcgcagcgtctgcgtttttgccctccggtcagggcatttaagggtcagcaatgagtttttacgcaattacgattcttgccttcggcatgtcgatggatgctttaactcacttcacaccccgaagggggaagttgcctgaccctacgattcccgctatttcattcactgaccggaggttcaaaatga

SEQ ID NO: 44 - DNA, 452 bp, Artificial Sequence
  Synthetic polynucleotide
atgaccctgaatatgatgatggatgccggccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacaccccgaagggggaagttgcctgaccctacgattcccgctatttcattcactgaccggaggttcaaaatga

SEQ ID NO: 45 - DNA, 410 bp, Artificial Sequence
  Synthetic polynucleotide
atgaccctgaatatgatgatggatgccggccctgtatgaagatggcgtgcgcaaagatcgcctggataacagcgatatgattagccagcttgaagcccgcattcgcgcgaaagcgtcaatgctggacgaagcgcgtcgtatcgatgtgcaacaggtagaaaaataaggttgctgggaagcggcaggcttcccgtgtatgatgaacccgcccggcgcgacccgttgttcgtcgcggccccgagggttcattttttgtattaataaagagaataaacgtggcaaaaaatattcaagccattcgcggcatgaacgattatctgcctggcgaactcacttcacaccccgaagggggaagttgcctgaccctacgattcccgctatttcattcactgaccggaggttcaaaatga

SEQ ID NO: 46 - DNA, 1071 bp, Artificial Sequence
  Synthetic polynucleotide
atgaaaaagattgatgcgattattaaacctttcaaactggatgacgtgcgctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcccgtccgcgcttaaactccaacatggacgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtccgtctcaactggctgacggagtttatgcctctcccgaccatcaagcattttatccgtactcctgatgatgcgtggttactcaccaccgcgattcctgggaaaacagccttccaggtattagaagaatatcctgattcaggtgaaaatattgttgatgcgctggccgtgttcctgcgccggttacattcgattcctgtttgtaattgtccttttaacagcgatcgtgtatttcgtcttgctcaggcgcaatcacgcatgaataacggtttggttgatgcgagtgattttgatgacgagcgtaatggctggcctgttgaacaagtctggaaagaaatgcacaagctcttgccattctcaccggattcagtcgtcactcatggtgatttctcacttgataaccttatttttgacgaggggaaattaataggttgtattgatgttggacgggtcggaatcgcagaccgttaccaggaccttgccattctttggaactgcctcggtgagttttctccttcattacagaaacggctttttcaaaaatatggtattgataatcctgatatgaataaattgcagtttcatttgatgctcgatgagtttttctaataagcctcgcgcgtgattcgtatccgcaccggcgaagaagacgacgcggcgatttaa

SEQ ID NO: 47 - DNA, 1295 bp, Artificial Sequence
  Synthetic polynucleotide
atgaccatgaacctgatgacggatgtcgtctcagccaccgggatcgccgggttgctttcacgacaacacccgacgctgttttttacactaattgaacaggcccccgtggcgatcacgctgacggataccgctgcccgcattgtctatgccaacccgggcgtgttgagtcatcctgactagctgagatgagggctcgcctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctccaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaataagcctgaccggtggtgaatttaatctcgctgacgtgtagacattcatcgatctgcatccacggtccggcggcggtacctgcctgacgctacgtttaccgctcttttatgaactgaccggaggcccaagatga

SEQ ID NO: 48 - DNA, 1491 bp, Artificial Sequence; identical to SEQ ID NO: 34
  Synthetic polynucleotide

SEQ ID NO: 49 - DNA, 1021 bp, Artificial Sequence; identical to SEQ ID NO: 35
  Synthetic polynucleotide

SEQ ID NO: 50 - DNA, 1071 bp, Artificial Sequence; identical to SEQ ID NO: 37
  Synthetic polynucleotide

SEQ ID NO: 51 - DNA, 461 bp, Artificial Sequence; identical to SEQ ID NO: 41
  Synthetic polynucleotide

SEQ ID NO: 52 - DNA, 426 bp, Artificial Sequence; identical to SEQ ID NO: 38
  Synthetic polynucleotide

SEQ ID NO: 53 - DNA, 452 bp, Artificial Sequence; identical to SEQ ID NO: 40
  Synthetic polynucleotide

SEQ ID NO: 54 - DNA, 426 bp, Artificial Sequence; identical to SEQ ID NO: 38
  Synthetic polynucleotide

SEQ ID NO: 55 - DNA, 461 bp, Artificial Sequence; identical to SEQ ID NO: 41
  Synthetic polynucleotide

SEQ ID NO: 56 - DNA, 1491 bp, Artificial Sequence; identical to SEQ ID NO: 34
  Synthetic polynucleotide

SEQ ID NO: 57 - DNA, 1491 bp, Artificial Sequence; identical to SEQ ID NO: 34
  Synthetic polynucleotide

SEQ ID NO: 58 - DNA, 1021 bp, Artificial Sequence; identical to SEQ ID NO: 35
  Synthetic polynucleotide

SEQ ID NO: 59 - DNA, 1491 bp, Artificial Sequence; identical to SEQ ID NO: 34
  Synthetic polynucleotide

SEQ ID NO: 60 - DNA, 1491 bp, Artificial Sequence; identical to SEQ ID NO: 34
  Synthetic polynucleotide

SEQ ID NO: 61 - DNA, 1563 bp, Artificial Sequence
  Synthetic polynucleotide
atgtttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaa

SEQ ID NO: 62 - DNA, 1536 bp, Kosakonia sacchari
  source (1)..(1536): 16S rDNA - contig 5, strain CI006
ttgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagtaaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagtaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 63 - DNA, 1537 bp, Kosakonia sacchari
  gene (1)..(1537): 16S rDNA - contig 8, strain CI006
  misc_feature (450)..(450): n is a, c, g, or t
  misc_feature (452)..(452): n is a, c, g, or t
  misc_feature (455)..(455): n is a, c, g, or t
  misc_feature (473)..(473): n is a, c, g, or t
ttgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggnantanggttaataacctgtgttnattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagtaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 64 - DNA, 1540 bp, Unknown
  Rahnella sp.
  gene (1)..(1540): 16S rDNA, strain CI019
  misc_feature (70)..(70): n is a, c, g, or t
  misc_feature (267)..(267): n is a, c, g, or t
  misc_feature (455)..(455): n is a, c, g, or t
  misc_feature (458)..(458): n is a, c, g, or t
  misc_feature (473)..(473): n is a, c, g, or t
  misc_feature (1135)..(1135): n is a, c, g, or t
attgaagagtttgatcatggctcagattgaacgctggcggcaggcctaacacatgcaagtcgagcggcancgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctnacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcancanacttaatacgtgtgntgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtnatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 65 - DNA, 882 bp, Kosakonia sacchari
  gene (1)..(882): nifH, strain CI006
atgaccatgcgtcaatgcgccatttacggcaaaggtgggatcggcaaatcgaccaccacacagaacctggtcgccgcgctggcggagatgggtaaaaaagtcatgattgtcggctgtgacccgaaagccgattccacgcgtttgatcctgcatgcgaaagcgcagaacaccattatggagatggctgctgaagtcggctccgtggaagacctggagttagaagacgtgctgcaaatcggttacggcggcgtgcgctgcgcagagtccggcggcccggagccaggcgtgggctgtgccggtcgcggggtgatcaccgcgattaacttcctcgaagaagaaggcgcttacgtgccggatctcgattttgttttctacgacgtgctgggcgacgtggtatgcggtggtttcgccatgccgattcgtgaaaacaaagcgcaggagatctacatcgtttgctctggcgaaatgatggcgatgtacgccgccaacaacatctccaaaggcatcgtgaaatacgccaaatccggtaaagtgcgcctcggcgggctgatttgtaactcgcgccagaccgaccgtgaagatgaactgatcattgcgctggcagaaaaactcggcacgcagatgatccactttgttccccgcgacaacattgtgcagcgtgcggaaatccgccgtatgacggttatcgaatatgacccgacctgcaatcaggcgaacgaatatcgcagccttgccagcaaaatcgtcaacaacaccaaaatggtggtgcccaccccctgcaccatggatgaactggaagaactgctgatggagttcggcattatggatgtggaagacaccagcatcattggtaaaaccgccgccgaagaaaacgccgtctga

SEQ ID NO: 66 - DNA, 1449 bp, Kosakonia sacchari
  gene (1)..(1449): NifD, strain CI006
atgagcaatgcaacaggcgaacgcaacctggagataatcgagcaggtgctcgaggttttcccggagaagacgcgcaaagaacgcagaaaacacatgatggtgacggacccggagcaggaaagcgtcggtaagtgcatcatctctaaccgcaaatcgcagccaggcgtgatgaccgtgcgcggctgctcgtatgccggttcgaaaggggtggtatttgggccaatcaaggatatggcgcatatctcgcatggcccaatcggctgcggccaatactcccgcgccgggcggcggaactactacaccggcgtcagcggcgtggacagcttcggcacgctcaacttcacctccgattttcaggagcgcgacatcgtgtttggcggcgataaaaagctcgccaaactgattgaagagctggaagagctgttcccgctgaccaaaggcatttcgattcagtcggaatgcccggtcggcctgattggcgatgacattgaggccgtcgcgaacgccagccgcaaagccatcaacaaaccggttattccggtgcgttgcgaaggctttcgcggcgtgtcgcaatccctcggtcaccatattgccaacgatgtgatccgcgactgggtgctggataaccgcgaaggcaaaccgttcgaatccaccccttacgatgtggcgatcatcggcgattacaacatcggcggcgatgcctgggcttcgcgcattttgctcgaagagatgggcttgcgggtggtggcacagtggtctggcgacggtacgctggtggagatggaaaacacgccgttcgtcaaactgaacctggtgcattgttaccgctcaatgaactacatctcgcgccatatggaggagaagcacggtattccgtggatggaatacaacttctttggtccgacgaaaatcgcggaatcgctgcgcaaaatcgccgaccagtttgacgacaccattcgcgccaacgccgaagcggtgatcgccagataccaggcgcaaaacgacgccattatcgccaaatatcgcccgcgtctggaggggcgcaaagtgctgctttatatgggcgggctgcgtccgcgccatgtgattggcgcctatgaagacctgggaatggagatcatcgctgccggttatgagttcggtcataacgatgattacgaccgcaccttgccggatctgaaagagggcacgctgctgtttgatgatgccagcagttatgagctggaggcgttcgtcaacgcgctgaaaccggatctcatcggttccggcatcaaagagaagtacatctttcagaaaatgggcgtgccgtttcgccagatgcactcctgggattactccggcccgtaccacggctatgacggcttcgccatcttcgcccgcgatatggatatgacgctcaacaaccccgcgtggggccagttgaccgcgccgtggctgaaatccgcctga

SEQ ID NO: 67 - DNA, 1563 bp, Kosakonia sacchari
  gene (1)..(1563): nifK, strain CI006
atgagccagactgctgagaaaatacagaattgccatcccctgtttgaacaggatgcttaccagacgctgtttgccggtaaacgggcactcgaagaggcgcactcgccggagcgggtgcaggaagtgtttcaatggaccactaccccggaatatgaagcgctgaactttaaacgcgaagcgctgactatcgacccggcaaaagcctgccagccgctgggcgcggtgctctgttcgctggggtttgccaataccctaccgtatgtgcacggttcacagggttgcgtggcctatttccgcacgtactttaaccgccactttaaagaaccggtggcctgcgtgtcggattcaatgacggaagacgcggcggtgttcggcgggaataacaacctcaacaccggcttacaaaacgccagcgcgctgtataaaccggagattatcgccgtctctaccacctgtatggcggaagtgatcggtgatgatttgcaggcctttatcgccaacgccaaaaaagatggttttctcgatgccgccatccccgtgccctacgcgcacacccccagttttatcggcagccatatcaccggctgggataacatgtttgaaggttttgcccggacctttacggcagaccatgaagctcagcccggcaaactttcacgcatcaacctggtgaccgggtttgaaacctatctcggcaatttccgcgtgctgaaacgcatgatggaacaaatggaggtgccggcgagtgtgctctccgatccgtcggaagtgctggatactcccgccaacgggcattaccagatgtacgcgggcgggacgacgcagcaagagatgcgcgaggcgccggatgctatcgacaccctgttgctgcagccctggcaactggtgaaaagcaaaaaagtggtgcaggagatgtggaatcagcccgccaccgaggtttctgttcccgttgggctggcaggaacagacgaactgttgatggcgattagccagttaaccggcaaggccattcccgattcactggcgctggagcgcgggcggctggtcgatatgatgctcgattcccacacctggttgcacggtaaaaaattcggcctgtttggcgatccggattttgtcatgggattgacccgtttcctgctggagctgggctgcgaaccgaccgttatcctctgccacaacggtaacaaacgctggcagaaagcaatgaagaaaatgcttgacgcctcgccgtacggccaggagagcgaagtgtttatcaactgcgatttgtggcatttccgctcgctgatgtttacccgccagccggattttatgattggcaactcgtacggcaagttcattcagcgcgacaccttagccaaaggcgagcagtttgaagttccgctgatccgcctcggttttcccctgttcgaccgccaccatctgcaccgccagaccacctggggctacgagggcgccatgagcattctcactacccttgtgaatgcggtactggagaaagtggacaaagagaccatcaagctcggcaaaaccgactacagcttcgatcttatccgttaa

SEQ ID NO: 68 - DNA, 1488 bp, Kosakonia sacchari
  gene (1)..(1488): nifL, strain CI006
atgaccctgaatatgatgatggatgccggcgcgcccgaggcaatcgccggtgcgctttcgcgacaccatcctgggctgttttttaccatcgttgaagaagcgcccgtcgccatttcgctgactgatgccgacgcacgcattgtctatgccaacccggctttctgccgccagaccggctatgaactagaagcgttgttgcagcaaaatccccgcctgcttgcaagtcgccaaaccccacgggaaatctatcaggatatgtggcacaccttgttacaacgccgaccgtggcgcgggcaattgattaaccgccaccgcgacggcagcctgtatctggtcgagatcgatatcaccccggtgattaacccgtttggcgaactggaacactacctggcaatgcagcgcgatatcagcgccagttatgcgctggagcagcggttgcgcaatcacatgacgctgaccgaagcggtgctgaataacattccggcggcggtggttgtagtggatgaacgcgatcatgtggttatggataaccttgcctacaaaacgttctgtgccgactgcggcggaaaagagctcctgagcgaactcaatttttcagcccgaaaagcggagctggcaaacggccaggtcttaccggtggtgctgcgcggtgaggtgcgctggttgtcggtgacctgctgggcgctgccgggcgtcagcgaagaagccagtcgctactttattgataacaggctgacgcgcacgctggtggtgatcaccgacgacacccaacaacgccagcagcaggaacagggccgacttgaccgccttaaacagcagatgaccaacggcaaactactggcagcgatccgcgaagcgcttgacgccgcgctgatccagcttaactgccccatcaatatgctggcggcggcgcgacgtttaaacggcagtgataacaacaatgtggcgctcgacgccgcgtggcgcgaaggtgaagaggcgatggcgcggctgaaacgttgccgcccgtcgctggaactggaaagtgcggccgtctggccgctgcaacccttttttgacgatctgcgcgcgctttatcacacccgctacgagcaggggaaaaatttgcaggtcacgctggattcccatcatctggtgggatttggtcagcgtacgcaactgttagcctgcctgagtctgtggctcgatcgcacgctggatattgccgccgggctgggtgatttcaccgcgcaaacgcagatttacgcccgcgaagaagagggctggctctctttgtatatcactgacaatgtgccgctgatcccgctgcgccacacccactcgccggatgcgcttaacgctccgggaaaaggcatggagctgcgcctgatccagacgctggtggcacaccaccacggcgcaatagaactcacttcacaccccgaagggggaagttgcctgaccctacgattcccgctatttcattcactgaccggaggttcaaaatga

SEQ ID NO: 69 - DNA, 1575 bp, Kosakonia sacchari
  gene (1)..(1575): nifA, strain CI006
atgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtcgctaacctggtcgcgcaaaccgtgcgtttgatggcaccaccggcagtgcgcccttccccgcgcgccgccataacacaggccgccagcccgaaatcctgcacggcctcacgcgcatttggttttgaaaatatggtcggtaacagtccggcgatgcgccagaccatggagattatccgtcaggtttcgcgctgggacaccaccgttctggtacgcggcgagagtggcaccggcaaggagctgattgccaacgccatccaccaccattcgccgcgtgccggtgcgccatttgtgaaattcaactgtgcggcgctgccggacacactgctggaaagcgaattgttcggtcacgagaaaggggcatttaccggcgcggtacgccagcgtaaaggccgttttgagctggccgatggcggcacgctgtttcttgacgagatcggcgagagtagcgcctcgtttcaggctaagctgctgcgcattttgcaggaaggcgaaatggaacgcgtcggcggcgacgagacattgcaagtgaatgtgcgcattattgccgcgacgaaccgcaatcttgaagatgaagtccggctggggcactttcgcgaagatctctattatcgcctgaatgtgatgcccatcgccctgccgccactacgcgaacgccaggaggacattgccgagctggcgcactttctggtgcgtaaaatcgcccataaccagagccgtacgctgcgcattagcgagggcgctatccgcctgctgatgagctacaactggcccggtaatgtgcgcgaactggaaaactgccttgagcgctcagcggtgatgtcggagaacggtctgatcgatcgggatgtgattttgtttaatcatcgcgaccagccagccaaaccgccagttatcagcgtctcgcatgatgataactggctcgataacaaccttgacgagcgccagcggctgattgcggcgctggaaaaagcgggatgggtacaagccaaagccgcgcgcttgctggggatgacgccgcgccaggtcgcctatcgtattcagacgatggatataaccctgccaaggctataa

SEQ ID NO: 70 - DNA, 876 bp, Unknown
  Rahnella sp.
  gene (1)..(876): nifH, strain CI019
atggcaatgcgtcaatgtgcaatctacgggaaagggggtattggtaaatccaccactacccaaaaccttgtagcggctctggccgaaatgaataagaaggtcatgatcgtcggctgtgaccctaaggctgattcaacccgcctcattctgcatgcgaaagcacagaacaccatcatggaaatggccgctgaagtgggctccgtggaagatctggagctggaagatgtgatgcaaatcggctatggcggcgtgcgctgtgcggaatcaggcggccctgagcctggtgtgggttgtgccggacgcggggtgatcaccgccatcaacttcctcgaagaagaaggcgcgtatgtgccggatctggatttcgtgttttacgacgtattgggcgatgtggtctgtggcggtttcgcgatgccaattcgcgaaaacaaagcgcaggaaatctacatcgtatgctccggtgaaatgatggcgatgtatgccgccaacaacatttccaaaggcatcgtgaaatacgcgaaatcgggcaaagttcgcctggccgggctgatctgtaactcccgccagacggatcgcgaagatgaactgatcatcgcgctggctgaaaaacttggcacgcaaatgatccacttcgtgccgcgtgacaacattgtgcaacgcgctgaaatccgccgcatgacggtcatcgaatacgacccgacttgtgcgcaggcagatcagtatcgtgcactggcgaacaaaatcgtcaacaacaccaaaatggtggtgccgacaccggtcaccatggatgagctggaagccctgttaatggaatttggcattatggaagaagaagacctgaccatcgtcggtcgtaccgccgccgaagaggcgtga

SEQ ID NO: 71 - DNA, 1449 bp, Unknown
  Rahnella sp.
  gene (1)..(1449): nifD, strain CI019
atgaccagtgaaacacgcgaacgtaacgaggcattgatccaggaagtgctggagatcttccccgagaaggcgcttaaagatcgtaagaaacacatgatgaccaccgacccggcgatggaatctgtcggcaagtgtattgtctcaaaccgcaaatcacagccgggcgtgatgaccgtgcgaggctgcgcttacgccggttccaaaggcgtggtctttggcccgatcaaagacatggcgcatatctcccacggcccggttggttgcggccagtattctcgtgccggacgccgtaactattacaccggctggagcggcgtgaacagctttggcaccctcaacttcaccagtgattttcaggaacgggacatcgtatttggcggcgataaaaagctcgacaaactgatcgacgaactggagatgttgttcccgctgaccaaaggcatttcggtacagtcggaatgtccggtcggtctgatcggcgatgacatttctgccgtcgccaaagccagcagcgccaaaatcggtaagccggtcgtgccggtacgctgcgaggggttccgcggtgtgtcgcaatcgctcggccatcacattgctaacgatgtcatccgcgactgggtgctggataaccgcgaaggcaatgaatttgaaaccacgccttacgacgtggcgattatcggcgactacaacatcggcggtgacgcctgggcctcacgtattctgctcgaagaaatggggctgcgtgtggtggcgcagtggtccggcgacggcacgctggtggagatggaaaacaccccgaaagtcgcactcaatctggtgcactgctaccgctcgatgaactacatctcccgtcatatggaagaaaaacacggcattccgtggatggaatacaacttctttggcccgaccaaaattgcggaatctctgcgcgaaatcgcggcgcgttttgacgataccatccggaaaaacgccgaagcggtgattgaaaaatatcaggcgcaaacgcaggcggtgatcgacaaataccgtccgcgtctggaaggcaaaaaggtgctgttgtatctcggcggtttacgtccgcgccacatcatcggggcgtatgaagatctgggaatggaaatcatcggtaccggctatgaattcggtcataacgatgattacgaccgcaccttaccgatgctcaaagaaggcacgttgctgttcgatgacctgagcagttatgagctggaagcgttcgttaaagcgctgaaaccggatcttgtcgggtcaggcatcaaagaaaaatacattttccagaaaatgggcgtgccgttccgccagatgcactcctgggattattccggcccttatcacggctacgacggtttcggcatttttgcccgtgacatggacatgacgctgaacaatccgggctggagtcagctgaccgccccctggttgaaatcggcctga

SEQ ID NO: 72 - DNA, 1569 bp, Unknown
  Rahnella sp.
  gene (1)..(1569): nifK, strain CI019
atgagtcaagatcttggcaccccaaaatcctgtttcccgctgttcgagcaggatgaataccagagtatgtttacccacaaacgcgcgctggaagaagcacacggcgaggcgaaagtgcgggaagtgtttgaatggaccaccacgcaggaatatcaggatctgaacttctcgcgtgaagcgctgaccgtcgacccggcgaaagcctgccagccgttaggcgcggtactttgcgcgctgggttttgccaacacgttgccgtatgtccacggttcacaaggctgtgtggcgtatttccgtacctattttaatcgtcatttcaaagagccggtggcctgtgtttccgactcaatgaccgaagatgccgccgtttttggcggaaataacaacatgaatgtcggtctggaaaacgccagcgcgctgtacaagccggaaattattgctgtctccaccacctgtatggcggaagtgatcggtgatgacctgcaggcttttatcgccaacgccaaaaaagacggatttgtggatgccggtatgccaatcccgtatgcccatacaccgagttttctgggcagtcatgtcaccggctgggacaacatgtttgaaggcttcgcccgtacctttaccaccgacgccacgcgggaatatcagccgggcaaacttgccaaactgaacgtggtgaccggttttgaaacttatctcggcaactaccgggttattcaccgcatgatgagccagatgggggtcgaatgcagcgtcttgtccgatccgtctgaagtgctcgacaccccggctgacggccaataccgcatgtatgccggcggcaccacgcaaaccgaaatgcgtgatgcaccggatgccatcgacaccttgctgctgcaaccgtggcaattgcagaaaaccaaaaaagtggtgcagggcgactggaatcagccgggcaccgaagtcagtgtaccgattggcctggcggcgaccgatgccttgctgatgacggtaagcgaactgaccggcaaaccgatagctgacacgctggcgactgaacgtggccgtctggtggacatgatgctcgattcccacacctggctgcatggcaagcgtttcggtctctacggtgacccggattttgtgatgggcatgaccgcattcctgctggaactgggctgtgaaccgaccaccattctcagccataacggcaacaaacgctggcagaaagccatgaagaaaatgctggctgattcgccttacgggcaggacagcgaagtgtatgtgaactgcgatctgtggcatttccgctcgctgatgtttacccgtaaaccggactttatgatcggcaactcttacggaaaattcattcagcgtgacacgctggccaaaggcgaacagttcgaagtgccgctgatccgcatcggttttccgatttttgaccggcaccatttgcaccgtcagaccacctggggatacgaaggggcgatgagcatactgacgcaactggtgaatgcggtacttgaacaactggatcgcgaaaccatgaagctcggcaaaaccgactacaacttcgacctgatccgctaa

SEQ ID NO: 73 - DNA, 1488 bp, Unknown
  Rahnella sp.
  gene (1)..(1488): nifL, strain CI019
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggccagccagcagacgccgaaacatatctatgacgaaatgtggcgcactttgttgcagggcaaatcctggaacggccaactgatcaaccggcgtaataaccgttcgctttatctggcggatgtcactatcacgcctgttttaggcgcggacgggcaggtggagcattacctcggcatgcacaaagatatcagcgagaaatacgcgctggaacagcggttgcgcaaccacatcaccttgttcacggaggtgctgaacaatattcccgccgccgtggtggtggtggatgagcaggacaatgtggtgatggacaatctggcctacaaaaccctttgcgcggactgcggcggcaaagagctgctggctgaaatgggctatccgcaactcaaagagatgctcaacagtggcgaaccggtgccggtttccatgcgcggcaacgtacgctggttttctttcggtcaatggttattgcagggcgttaatgaagaggccagccgcttttttaccggcattaccgcgccgggaaaactgattgttctgaccgactgcaccgatcagcatcaccggcagcagcagggttatcttgaccggcttaagcaaaaactcaccaacggcaaattattggcggccatccgtgagtcgctcgatgccgcgcttatccagctcaacgggccaatcaatatgctggcggctgcgcgtcgtcttaacggcgaagaaggcaacaacatggcgctggaattcgcctggcgcgaaggcgagcaggcggtgagtcgcttacaggcctgccgtccgtcgctggattttgagccgcaggcagaatggccggtcagtgaattctttgacgatctgagcgcgctgtacgacagccattttctcagtgacggtgaattgcgttacgtggtcatgccatctgatctgcacgctgtcgggcaacgaacgcaaatccttaccgcgctgagcttatggattgatcacacgctgtcacaggcgcaggccatgccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 74 - DNA, 1557 bp, Unknown
  Rahnella sp.
  gene (1)..(1557): nifA, strain CI019
atgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtcgccaatctcatcagccagccactgcgttctgccacgcccccggaatcattgcctgctcaaacgccggtccggtgcagtgttccgcgccagtttggtttcgagcagatggtcgggaaaagtcaggcgatgcgccagacgatggacattttacggcaggtttccaaatgggataccacggttctggtgcgtggtgaaagcggcaccggcaaggaacttatcgccaatgccattcattacaactcaccccgtgcggccgcgccatttgtgaaattcaactgcgccgcgctgccggataacctgctggaaagcgaactgttcggtcatgaaaaaggggccttcaccggcgctatccgtacccgtaaaggccgctttgaactggcggacgggggcacgttattcctcgatgaaatcggcgaatcgagcgcgtcgtttcaggccaaattgctgcgcattttgcaggaaggtgaaatggaacgggtcggcggcgataccacgctgaaagttgatgtgcgcattattgctgccaccaaccgtaatcttgaagaggaagtgcgtgccgggaattttcgcgaagacctgtattatcgcctgaacgtgatgccggtttcgctgcctgcactgcgtgaaaggctggatgatatcgccgatctggcgccgtttctggtcaaaaagattgcgctgcgtcaggggcgggaactgcgcatcagcgacggtgcggtgcgtctgctgatgacctacagctggccaggcaacgtgcgtgaactggaaaactgtctcgaacgggcgtcggtaatgaccgatgaagggctgatcgaccgcgacgtgatcctgttcaatcaccatgaatccccggcgctgtccgtcaaacccggcctgccgctcgcgacagatgaaagctggctggatcaggaactcgacgaacgccagcgggtgattgccgcactggagaaaaccggctgggtgcaggccaaagcggcccgactgctgggcatgacaccgcgccagattgcctaccgtatccagattatggacatcaacatgcaccgtatctga

SEQ ID NO: 75 - DNA, 1314 bp, Kosakonia sacchari
  misc_feature (1)..(1314): Prm5 with 500bp flanking regions, strain CI006
aaaactaccgccgcaattaatgaacccaacgctactgttgccgggccatgctcttccccggcgcgctgcccggaaaggatatagattgcccagcacgcgccagcaccaagcgcgaacgccgcgccagtgagatcaacatgtgaaacattttcgcccagcggcagcagatacaagaggccaagtaccgccaggatcacccagatgaaatccaccgggcggcgtgaggcaaaaagcgccaccgccagcgggccggtaaattccagcgccaccgcaacgccgagcggtatcgtctggatcgataaatagaacatatagttcatggcgccgagcgacaggccataaaacagcagtggcaggcgttgttcacgggtaaaatgtaaacgccagggcttgaacactacgaccaaaataagggtgccaagtgcgagacgcagcgcggtgacgccgggtgcgccaacaatcggaaacagtgatttcgccagcgacgcgcctccctgaatggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaactttctgttacatcaaatggcgctttagaccccaattcccgcaaagagtttcttaactaattttgatatatttaaacgcgtaggacgtaggatttacttgaagcacatttgaggtggattatgaaaaaaattgcatgtctttcagcactggccgcacttctggcggtttctgcaggttccgcagtagcagcaacttcaaccgtaactggcggctacgctcagagcgacgctcagggtattgctaacaaaactaacggtttcaacctgaaatatcgctacgagcaggacaacaacccgctgggtgttatcggttcctttacttacactgaaaaagatcgcaccgaaagcagcgtttataacaaagcgcagtactacggcatcaccgcaggcccggcttaccgcatcaacgactgggcgagcatctacggtgttgtgggtgtaggttacggtaaattccagcagactgtagacaccgctaaagtgtctgacaccagcgactacg

SEQ ID NO: 76 - DNA, 3413 bp, Kosakonia sacchari
  misc_feature (1)..(3413): nifLA operon - upstream intergenic region plus nifL and nifA CDSs, strain CI006
aacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcgcgcccgaggcaatcgccggtgcgctttcgcgacaccatcctgggctgttttttaccatcgttgaagaagcgcccgtcgccatttcgctgactgatgccgacgcacgcattgtctatgccaacccggctttctgccgccagaccggctatgaactagaagcgttgttgcagcaaaatccccgcctgcttgcaagtcgccaaaccccacgggaaatctatcaggatatgtggcacaccttgttacaacgccgaccgtggcgcgggcaattgattaaccgccaccgcgacggcagcctgtatctggtcgagatcgatatcaccccggtgattaacccgtttggcgaactggaacactacctggcaatgcagcgcgatatcagcgccagttatgcgctggagcagcggttgcgcaatcacatgacgctgaccgaagcggtgctgaataacattccggcggcggtggttgtagtggatgaacgcgatcatgtggttatggataaccttgcctacaaaacgttctgtgccgactgcggcggaaaagagctcctgagcgaactcaatttttcagcccgaaaagcggagctggcaaacggccaggtcttaccggtggtgctgcgcggtgaggtgcgctggttgtcggtgacctgctgggcgctgccgggcgtcagcgaagaagccagtcgctactttattgataacaggctgacgcgcacgctggtggtgatcaccgacgacacccaacaacgccagcagcaggaacagggccgacttgaccgccttaaacagcagatgaccaacggcaaactactggcagcgatccgcgaagcgcttgacgccgcgctgatccagcttaactgccccatcaatatgctggcggcggcgcgacgtttaaacggcagtgataacaacaatgtggcgctcgacgccgcgtggcgcgaaggtgaagaggcgatggcgcggctgaaacgttgccgcccgtcgctggaactggaaagtgcggccgtctggccgctgcaacccttttttgacgatctgcgcgcgctttatcacacccgctacgagcaggggaaaaatttgcaggtcacgctggattcccatcatctggtgggatttggtcagcgtacgcaactgttagcctgcctgagtctgtggctcgatcgcacgctggatattgccgccgggctgggtgatttcaccgcgcaaacgcagatttacgcccgcgaagaagagggctggctctctttgtatatcactgacaatgtgccgctgatcccgctgcgccacacccactcgccggatgcgcttaacgctccgggaaaaggcatggagctgcgcctgatccagacgctggtggcacaccaccacggcgcaatagaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtcgctaacctggtcgcgcaaaccgtgcgtttgatggcaccaccggcagtgcgcccttccccgcgcgccgccataacacaggccgccagcccgaaatcctgcacggcctcacgcgcatttggttttgaaaatatggtcggtaacagtccggcgatgcgccagaccatggagattatccgtcaggtttcgcgctgggacaccaccgttctggtacgcggcgagagtggcaccggcaaggagctgattgccaacgccatccaccaccattcgccgcgtgccggtgcgccatttgtgaaattcaactgtgcggcgctgccggacacactgctggaaagcgaattgttcggtcacgagaaaggggcatttaccggcgcggtacgccagcgtaaaggccgttttgagctggccgatggcggcacgctgtttcttgacgagatcggcgagagtagcgcctcgtttcaggctaagctgctgcgcattttgcaggaaggcgaaatggaacgcgtcggcggcgacgagacattgcaagtgaatgtgcgcattattgccgcgacgaaccgcaatcttgaagatgaagtccggctggggcactttcgcgaagatctctattatcgcctgaatgtgatgcccatcgccctgccgccactacgcgaacgccaggaggacattgccgagctggcgcactttctggtgcgtaaaatcgcccataaccagagccgtacgctgcgcattagcgagggcgctatccgcctgctgatgagctacaactggcccggtaatgtgcgcgaactggaaaactgccttgagcgctcagcggtgatgtcggagaacggtctgatcgatcgggatgtgattttgtttaatcatcgcgaccagccagccaaaccgccagttatcagcgtctcgcatgatgataactggctcgataacaaccttgacgagcgccagcggctgattgcggcgctggaaaaagcgggatgggtacaagccaaagccgcgcgcttgctggggatgacgccgcgccaggtcgcctatcgtattcagacgatggatataaccctgccaaggctataa

SEQ ID NO: 77 - protein, 495 aa, Kosakonia sacchari
  MISC_FEATURE (1)..(495): NifL, strain CI006
MTLNMMMDAGAPEAIAGALSRHHPGLFFTIVEEAPVAISLTDADARIVYANPAFCRQTGYELEALLQQNPRLLASRQTPREIYQDMWHTLLQRRPWRGQLINRHRDGSLYLVEIDITPVINPFGELEHYLAMQRDISASYALEQRLRNHMTLTEAVLNNIPAAVVVVDERDHVVMDNLAYKTFCADCGGKELLSELNFSARKAELANGQVLPVVLRGEVRWLSVTCWALPGVSEEASRYFIDNRLTRTLVVITDDTQQRQQQEQGRLDRLKQQMTNGKLLAAIREALDAALIQLNCPINMLAAARRLNGSDNNNVALDAAWREGEEAMARLKRCRPSLELESAAVWPLQPFFDDLRALYHTRYEQGKNLQVTLDSHHLVGFGQRTQLLACLSLWLDRTLDIAAGLGDFTAQTQIYAREEEGWLSLYITDNVPLIPLRHTHSPDALNAPGKGMELRLIQTLVAHHHGAIELTSHPEGGSCLTLRFPLFHSLTGGSK

SEQ ID NO: 78 - protein, 524 aa, Kosakonia sacchari
  MISC_FEATURE (1)..(524): NifA, strain CI006
MTQRTESGNTVWRFDLSQQFTAMQRISVVLSRATEVDQTLQQVLCVLHNDAFLQHGMICLYDSQQAILNIEALQEADQQLIPGSSQIRYRPGEGLVGTVLSQGQSLVLARVADDQRFLDRLGLYDYNLPFIAVPLIGPDAQTFGVLTAQPMARYEERLPACTRFLETVANLVAQTVRLMAPPAVRPSPRAAITQAASPKSCTASRAFGFENMVGNSPAMRQTMEIIRQVSRWDTTVLVRGESGTGKELIANAIHHHSPRAGAPFVKFNCAALPDTLLESELFGHEKGAFTGAVRQRKGRFELADGGTLFLDEIGESSASFQAKLLRILQEGEMERVGGDETLQVNVRIIAATNRNLEDEVRLGHFREDLYYRLNVMPIALPPLRERQEDIAELAHFLVRKIAHNQSRTLRISEGAIRLLMSYNWPGNVRELENCLERSAVMSENGLIDRDVILFNHRDQPAKPPVISVSHDDNWLDNNLDERQRLIAALEKAGWVQAKAARLLGMTPRQVAYRIQTMDITLPRL

SEQ ID NO: 79 - DNA, 2850 bp, Kosakonia sacchari
  gene (1)..(2850): glnE, strain CI006
atgccgcaccacgcaggattgtcgcagcactggcaaacggtattttctcgtctgccggaatcgctcaccgcgcagccattgagcgcgcaggcgcagtcagtgctcacttttagtgattttgttcaggacagcatcatcgcgcatcctgagtggctggcagagcttgaaagcgcgccgccgcctgcgaacgaatggcaacactatgcgcaatggctgcaagcggcgctggatggcgtcaccgatgaagcctcgctgatgcgcgcgctgcggctgtttcgccgtcgcatcatggtgcgcatcgcctggagccaggcgttacagttggtggcggaagaagatatcctgcaacagcttagcgtgctggcggaaaccctgatcgtcgccgcgcgcgactggctttatgaggcctgctgccgtgagtggggaacgccgagcaatccacaaggcgtggcgcagccgatgctggtactcggcatgggcaaactgggtggcggcgaactcaatttctcatccgatatcgatttgattttcgcctggccggaaaatggcgcaacgcgcggtggacgccgtgagctggataacgcgcaatttttcactcgccttggtcaacggctgattaaagtcctcgaccagccaacgcaggatggctttgtctaccgcgtcgatatgcgcttgcgcccgtttggcgacagcggcccgctggtgctgagctttgccgcgctggaagattactaccaggagcaggggcgcgattgggaacgctacgcgatggtgaaagcgcgcattatgggcgataacgacggcgaccatgcgcgggagttgcgcgcaatgctgcgcccgtttgttttccgccgttatatcgacttcagcgtgattcagtccctgcgtaacatgaaaggcatgattgcccgcgaagtgcgtcgccgtggcctgaaggacaacattaagctcggcgcgggcgggatccgcgaaatagaatttatcgtccaggttttccagctgattcgcggcggtcgcgagcctgcactgcaatcgcgttcactgttgccgacgcttgctgccatagatcaactgcatctgctgccggatggcgacgcaacccggctgcgcgaggcgtatttgtggctgcgacggctggagaacctgctgcaaagcatcaatgacgaacagacacagacgctgccgggcgatgaactgaatcgcgcgcgcctcgcctggggaatgggcaaagatagctgggaagcgctctgcgaaacgctggaagcgcatatgtcggcggtgcgtcagatatttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaa

SEQ ID NO: 80 - DNA, 1563 bp, Kosakonia sacchari; identical to SEQ ID NO: 61
  gene (1)..(1563): glnE_KO1, strain CI006

SEQ ID NO: 81 - protein, 949 aa, Kosakonia sacchari
  MISC_FEATURE (1)..(949): glnE, strain CI006
MPHHAGLSQHWQTVFSRLPESLTAQPLSAQAQSVLTFSDFVQDSIIAHPEWLAELESAPPPANEWQHYAQWLQAALDGVTDEASLMRALRLFRRRIMVRIAWSQALQLVAEEDILQQLSVLAETLIVAARDWLYEACCREWGTPSNPQGVAQPMLVLGMGKLGGGELNFSSDIDLIFAWPENGATRGGRRELDNAQFFTRLGQRLIKVLDQPTQDGFVYRVDMRLRPFGDSGPLVLSFAALEDYYQEQGRDWERYAMVKARIMGDNDGDHARELRAMLRPFVFRRYIDFSVIQSLRNMKGMIAREVRRRGLKDNIKLGAGGIREIEFIVQVFQLIRGGREPALQSRSLLPTLAAIDQLHLLPDGDATRLREAYLWLRRLENLLQSINDEQTQTLPGDELNRARLAWGMGKDSWEALCETLEAHMSAVRQIFNDLIGDDETDSPEDALSESWRELWQDALQEEDSTPVLAHLSEDDRRRVVALIADFRKELDKRTIGPRGRQVLDHLMPHLLSDVCSRDDAPVPLSRLTPLLTGIITRTTYLELLSEFPGALKHLISLCAASPMVASQLARYPILLDELLDPNTLYQPTAMNAYRDELRQYLLRVPEDDEEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 82 - protein, 520 aa, Kosakonia sacchari
  MISC_FEATURE (1)..(520): GlnE_KO1, strain CI006
MFNDLIGDDETDSPEDALSESWRELWQDALQEEDSTPVLAHLSEDDRRRVVALIADFRKELDKRTIGPRGRQVLDHLMPHLLSDVCSRDDAPVPLSRLTPLLTGIITRTTYLELLSEFPGALKHLISLCAASPMVASQLARYPILLDELLDPNTLYQPTAMNAYRDELRQYLLRVPEDDEEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 83 - protein, 341 aa, Kosakonia sacchari
  MISC_FEATURE (1)..(341): GlnE ATase domain, strain CI006
EEQQLEALRQFKQAQLLRVAAADIAGTLPVMKVSDHLTWLAEAIIDAVVQQAWGQMVARYGQPTHLHDREGRGFAVVGYGKLGGWELGYSSDLDLVFLHDCPMDVMTDGEREIDGRQFYLRLAQRVMHLFSTRTSSGILYEVDARLRPSGAAGMLVTTTESFADYQQNEAWTWEHQALARARVVYGDPQLTAEFDAIRRDILMTPRDGATLQTDVREMREKMRAHLGNKHKDRFDLKADEGGITDIEFIAQYLVLRFAHDKPKLTRWSDNVRILEGLAQNGIMEEQEAQALTLAYTTLRDELHHLALQELPGHVALSCFVAERALIKTSWDKWLVEPCAPA

SEQ ID NO: 84 - DNA, 1342 bp, Kosakonia sacchari
  misc_feature (1)..(1342): Prm5 inserted into nifL region, strain CI006, now strain CM029
ccgagcgtcggggtgcctaatatcagcaccggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatc

SEQ ID NO: 85 - DNA, 1270 bp, Rahnella aquatilis
  gene (1)..(1270): 16S
  misc_feature (186)..(186): n is a, c, t, g, unknown or other
  misc_feature (458)..(458): n is a, c, t, g, unknown or other
  misc_feature (1041)..(1041): n is a, c, t, g, unknown or other
  misc_feature (1131)..(1132): n is a, c, t, g, unknown or other
  misc_feature (1135)..(1135): n is a, c, t, g, unknown or other
  misc_feature (1139)..(1140): n is a, c, t, g, unknown or other
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgnaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcanacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtganacaggtgctgcatggctgtcgtcagctcgtgttgtgaaatgttgggttaagtcccgcaacgagcgcaacccttatcctttgttgccagcnngtnatgnngggaactcaaaggagactgccggtgataaaccggaggaaggtggggatgacgtcaagtcatcatggcccttacgagtagggctacacacgtgctacaatggcatatacaaagagaagcgaactcgcgagg

SEQ ID NO: 86 - DNA, 876 bp, Rahnella aquatilis
  gene (1)..(876): nifH
atggcaatgcgtcaatgcgcaatctacgggaaagggggtattgggaaatccaccactacccaaaaccttgtagcggctctggccgaaatgaataagaaggtcatgatcgtcggctgtgaccctaaggctgattcaacccgcctcattctgcatgcgaaagcacagaacaccatcatggaaatggccgctgaagtgggctccgtggaagatctggagctggaagatgtgatgcaaatcggctatggcggcgtgcgctgtgcggaatcaggcggccctgagcctggtgtgggttgtgccggacgcggggtgatcaccgccatcaacttcctcgaagaagaaggcgcgtatgtgccggatctggattttgtgttttacgacgtattgggcgatgtggtctgtggcggtttcgcgatgccaattcgcgaaaacaaagcgcaggaaatctacatcgtgtgctccggtgaaatgatggcgatgtatgccgccaacaacatttccaaaggcatcgtgaaatacgcgaaatcgggcaaagttcgcctggccgggctgatctgtaactcccgccagacggatcgcgaagatgaactgatcatcgcgctggctgaaaaacttggcacgcaaatgatccacttcgtgccgcgtgacaacattgtgcaacgcgctgaaatccgccgcatgacggtcatcgaatacgacccgacttgtgcgcaggcagatcagtatcgtgcactggcgaacaaaatcgtcaacaacaccaaaatggtggtgccgacaccggtcaccatggatgagctggaagccctgttaatggaatttggcattatggaagaagaagacctggccatcgtcggtcgtaccgccgccgaagaggcgtga

SEQ ID NO: 87 - DNA, 1374 bp, Rahnella aquatilis
  gene (1)..(1374): nifD1
atgaaggcaaaagagattctggcgctgattgatgagccagcctgtgagcataaccacaagcagaagtcgggttgcagcctgccgaaaccgggcgcgacggcaggcggttgtgcgtttgatggcgcgcagattgcgctgctgccggtcgcggacgtcgcgcatctggtgcacggcccgattggctgtaccggcagttcatgggacaaccgtggcagccgcagttccgggccttccatcaaccgcatgggcttcaccaccgacatgagcgagcaggatgtgattatggggcgcggcgagcgacgcttatttcacgccgtgcagcacatcgtcagccattaccatccggtggcggtctttatttacaacacctgcgtacccgcgatggaaggggatgacgttgaagccgtgtgtcgcgccgcatcggccgctgccggtgtgccggttatttcagtcgatgccgccggtttctacggcagcaaaaatctcggtaaccgcattgccggggacgtgatggtcaaaaaggtgatcggccagcgcgaacccgcgccgtggccggaaaactcaccgatccccgccggacaccgccacagcatcagcctgattggcgaattcaatattgccggcgagttctggcacgttctgccgctgctcgatgagctcgggatccgcgtgctgtgcagcctttccggggattcccgttttgctgaaatccagactatgcaccgtggcgaagccaacatgctggtgtgctcgcgggcgctgatcaacgtcgcccgaaaaatggaagagcgttaccagatcccatggtttgaaggcagtttttatggcctgcgttccatggctgattccctgcgcacgatcgccgtgctgctcaaagacccggatttacaggcgcgcacagaacgtctgattgagcgcgaggaggcggcgacacatcttgcgcttgcgccttaccgtgcgcggctcagcgggcgcaaggcgctgctgtataccggtggcgtgaaatcctggtcggtggtctcggcgttacaggatttaggcatcacggtggtggcgaccggcacccgaaaatcaaccgaagaagacaagcagcgtattcgcgaactgatgggtgaagacgtgctgatgctcgacgaaggcaatgccagaaccttgctcgacaccctctatcgtttcggcggcgacatcatgatcgccgggggccgcaacatgtataccgcgtacaaagcccgcctgccgttcctggatatcaatcaggagcgcgagcatgcgtttgccggatatcacgggctggtaaatctggccgaacagttgtgtatcaccctggaaagcccggtctgggcgcaggtcaaccgtctggcgccgtggcgctaa

SEQ ID NO: 88 - DNA, 1449 bp, Rahnella aquatilis
  gene (1)..(1449): nifD2
atgaccagtgaaacacgcgaacgtaacgaggcattgatccaggaagtgctggagatcttccccgagaaggcgcttaaagatcgtaagaaacacatgatgaccaccgacccggcgatggaatctgtcggcaagtgtattgtctcaaaccgcaaatcacagccgggcgtgatgaccgtgcgaggctgcgcttacgccggttccaaaggcgtggtctttggcccgatcaaagacatggcgcatatctcccacggcccggttggttgcggccagtattcccgtgccggacgccgtaactattacaccggctggagcggcgtgaacagctttggcaccctcaacttcaccagtgattttcaggaacgggacatcgtatttggcggcgataaaaagctcgacaaattgatcgatgaactggagatgttgttcccgctgagcaaaggcatttcggtgcagtcggaatgtccggtcggtctgatcggcgatgacatttctgccgtcgccaaagccagcagcgccaaaatcggtaagccggtcgtgccggtacgctgcgaggggttccgcggtgtgtcgcaatcgctcggccatcacattgctaacgatgtcatccgcgactgggtgctggataaccgcgaaggcaatgaatttgaaaccacgccttacgacgtggcgattatcggcgactacaacatcggcggtgacgcctgggcctcacgtattctgctcgaagaaatggggctgcgcgtggtggcgcagtggtccggcgacggcacgctggtggagatggaaaacaccccgaaagtcgcgctcaatctggtgcactgctaccgctcgatgaactacatctcccgtcatatggaagaaaaacacggcattccgtggatggaatacaacttctttggcccgaccaaaattgcggaatctctgcgcgaaatcgcggcgcgttttgacgataccatccggaaaaacgccgaagcggtgattgaaaaatatcaggcgcaaacgcaggcggtgatcgacaaataccgtccgcgtctggaaggcaaaaaggtgctgttgtatctcggcggtttacgtccgcgccacatcatcggggcgtatgaagatctgggaatggaaatcatcggtaccggctatgaattcggtcataacgatgattacgaccgcaccttaccgatgctcaaagaaggcacgttgctgttcgatgacctgagcagttatgagctggaagcgttcgttaaagcgctgaaaccggatcttgtcgggtcaggtatcaaagaaaaatacattttccagaaaatgggcgtgccgttccgccagatgcactcctgggattattccggcccttatcacggctacgacggtttcggcatttttgcccgtgacatggacatgacgctgaacaatccgggctggagtcagctgaccgccccctggttgaaaacggcctga

SEQ ID NO: 89 - DNA, 1386 bp, Rahnella aquatilis
  gene (1)..(1386): nifK1
atggctcaaattctgcgtaatgccaagccgcttgccaccacgcctgtcaaaagcgggcaaccgctcggggcgatcctggccagtcaggggctggaaaattgcatcccgctggttcacggcgcgcaaggttgtagcgcgttcgccaaagttttcttcatccagcattttcacgatccgatcccgttgcagtccacggcgatggaatcgaccacgactatcatgggctcggatggcaacgtcagtactgcgttgaccacgttgtgtcagcgcagtaatccaaaagccattgtgattttgagcaccggactgtcagaagcgcagggcagtgatttgtcgatggcgctgcgtgagtttcgcgacaaagaaccgcgctttaatgccatcgctattctgaccgttaacacgccggatttttacggctcgctggaaaacggctacagcgcgctgatggaaagcgtgatcactcagtgggtgccggaaaagccgccgaccggcatgcgtaacaagcgcgtgaacctgctggtgagccatctgctgacgccgggggatctggaattactgcgcagctatgtcgaagcctttggcctgcaaccggtgatcctgccggatttatcacagtcgctggacggacatctggcgaatggcgatttcaatccggtcacgcagggcggcacgtcgcaacgccagattgaacaaatggggcagagcctgaccaccattaccattggcagttcgctcaactgcgccgccagtctgatggcgatgcgcagccgtggcatggcgctgaacctgccgcacctgatgacgctggaaaacatggacagtctgatccgccatctgcatcaggtgtcaggccgcgaggtaccggcatggattgagcgccagcgcgggcaactgctggacgccatgatcgactgccatacctggctgcagtcacagcgtattgcgctggcggcagaagcggatttgctggtggcgtggtgcgatttcgctcagagccagggaatgcgcgtcgggccggtgattgcgccggttaatcagcagtcactggccgggctgccggtcgaacaggtggtgatcggcgatctggaagatttacaaacccggctcgacagctacccggtttcactgctggtggcgaactcccacgctgcaccactggcggaaaaaaacggtatcgcgctggtacgtgccggtttcccgctttacgaccgtctcggggaatttcgccgcgtgcggcagggctatgcgggtattcgcgacaccttgttcgaactcgcgaacctgatgcaggcgcgccatcacatgctgacggcgtatcactcaccgcttaggcaggtgttcggcctgagcccggtaccggaggccagtcatgaggcgcgctaa

SEQ ID NO: 90 - DNA, 1569 bp, Rahnella aquatilis
  gene (1)..(1569): nifK2
atgagtcaagatcttggcaccccaaaatcctgtttcccgctgttcgagcaggatgaataccagaatatgtttacccacaaacgcgcgctggaagaagcacacggcgaggcgaaagtgcgggaagtgtttgaatggaccaccacgcaggaatatcaggatctgaacttctcgcgtgaagcgctgaccgtcgacccggcgaaagcctgccagccgttaggcgcggtactttgcgcgctgggttttaccaacacgttgccgtatgtccatggttcacaaggctgtgtggcgtatttccgtacctattttaatcgtcatttcaaagagccggtggcctgtgtttccgactcaatgaccgaagatgccgccgtttttggcggaaataacaacatgaatgtcggtctggaaaacgccagcgcgctgtacaagccggaaattattgcggtctccaccacctgtatggcggaagtgatcggtgatgacctgcaggcttttatcgccaacgccaaaaaagacggatttgtggatgccggtatgccaatcccgtatgcccatacaccgagttttctgggcagtcatgtcaccggctgggacaacatgtttgaaggcttcgcccgtacctttaccaccgacgccacgcgggaatatcagccgggcaaacttgccaaactgaacgtggtgaccggttttgaaacttatctcggcaactaccgggttattcaccgcatgatgagccagatgggggtcgaatgcagcgtcttgtccgatccgtctgaagtgctcgacaccccggctgacggccaataccgcatgtatgccggcggcaccacgcaaaccgaaatgcgtgatgcaccggatgccatcgacaccttgctgctgcaaccgtggcaattacagaaaaccaaaaaggtggtgcagggcgactggaatcagccgggcaccgaagtcagtgtaccgattggcctggcggcgaccgatgccttgctgatgacggtaagcgaactgaccggcaaaccgatagctgacgcgctggcgactgaacgtggccgtctggtggacatgatgctcgattctcacacctggctgcacggcaagcgtttcggtctctacggtgacccggattttgtgatgggcatgaccgcattcctgctggaactgggctgtgaaccgaccaccattctcagccataacggcaacaaacgctggcagaaagccatgaagaaaatgctggctgattcgccttacggacaggacagcgaagtgtatgtgaactgcgatctgtggcatttccgctcgctgatgtttacccgtaaaccggactttatgatcggcaactcttacggaaaattcattcagcgtgacacgctggccaaaggcgaacagttcgaagtgccgctgatccgtatcggattcccgatttttgaccggcaccatttgcaccgtcagaccacctggggatacgagggcgcgatgagcatcctgacgcaactggtgaatgcggtgctcgaacagctggatcgcgaaaccatgaagctcggcaaaaccgactacaacttcgatctgatccgctaa

SEQ ID NO: 91 - DNA, 1488 bp, Rahnella aquatilis
  gene (1)..(1488): nifL
atgagcatcacggcgttatcagcatcatttcctgaggggaatatcgccagccgcttgtcgctgcaacatccttcactgttttataccgtggttgaacaatcatcggtggcgatttcgctgaccgatccgcaggcgcgcatttgttatgccaatccggcattctgccgccagacgggttttgcacttgagacacttttgggcgagaaccaccgtctgctggccagccagcagacgccgaaacatatctatgacgaaatgtggcgcactttgttgcagggcaaatcctggaacggccaactgatcaaccggcgtaataaccgttcgctttatctggcggatgtcactatcacgcctgttttaggcgcggacgggcaggtggagcattacctcggcatgcacaaagatatcagcgagaaatacgcgctggagcagcggttgcgcaaccacatcaccttgttcacggaggtgctgaacaatattcccgccgccgtggtggtggtggatgagcaggacaatgtggtgatggacaatctggcctacaaaaccctgtgcgctgactgcggcggaaaagagctgttggccgaaatgggctatccgcaactcaaagagatgctcaacagtggcgaaccggtgccggtttccatgcgcggcaacgtacgctggttttctttcggtcagtggtcattgcagggcgttaatgaagaggccagccgcttttttaccggcattaccgcgccgggaaaactgattgttctcaccgactgcaccgatcagcatcaccggcagcagcagggttatcttgaccggctcaagcaaaaacttaccaacggcaaattgctggcagccatccgcgagtcgcttgatgccgcgctgattcagctcaacgggccaattaatatgctggcggctgcgcgtcgtcttaacggcgaagaaggcaacaacatggcgctggaattcgcctggcgcgaaggcgagcaggcggtgagtcgcttacaggcctgccgtccgtcgctggattttgagccgcaggcagaatggccggtcagtgaattcttcgacgatctgagcgcgctgtacgacagccattttctcagtgacggtgaattgcgttacgtggtcatgccatctgatctgcacgctgtcgggcaacgaacgcaaatccttaccgcgctgagcttatggattgatcacacgctgtcacaggcgcaggccatgccgtctctgaagctctcggtgaacattgttgcgaagcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 92 - DNA, 1557 bp, Rahnella aquatilis
  gene (1)..(1557): nifA
atgacccagttacctaccgcgggcccggttatccggcgctttgatatgtctgcccagtttacggcgctttatcgcatcagcgtggcgctgagtcaggaaagcaataccgcgcgcgcactggcggcgatcctcgaagtgcttcacgatcatgcatttatgcaatacggcatggtgtgtctgttcgataaagaacgcaatgcactgtttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgctgattggtgtgccgatccccggtgcggataatcagcctgcgggtgtgctggtggcacagccgatggcgttgcacgaagaccggctggctgccagtacgcggtttttagaaatggtcgccaatctcatcagccagccactgcgttctgccacgcccccggaatcattgcctgctcaaacgccggtccggtgcagtgttccgcgccagtttggttttgagcagatggtcgggaaaagtcaggcgatgcgccagacgatggacattttacggcaggtttccaaatgggataccacggttctggtgcgtggtgaaagcggcaccggcaaggaacttatcgccaatgccattcattacaactcaccccgtgcggccgcgccatttgtgaaattcaactgcgccgcgctgccggataacctgctggaaagcgaactgttcggtcatgaaaaaggggccttcaccggcgctatacgcacccgaaaaggccgctttgaactggcggacgggggcacgttattcctcgatgaaatcggcgaatcgagcgcgtcgtttcaggccaaattgctgcgcattttgcaggaaggtgaaatggaacgggtcggcggcgataccacgctgaaagttgatgtgcgcattattgctgccaccaaccgtaatcttgaggaggaagtgcgtgccgggaattttcgcgaagacctgtattatcgcctgaacgtgatgccggtttcgctgcctgcactgcgtgaaaggctggatgatatcgccgatctggcgccgtttctggtcaaaaagattgcgctgcgtcaggggcgggaactgcgcatcagtgatggtgcggtgcgtctgctgatgacctacagctggccaggcaacgtgcgtgaactggaaaactgcctcgaacgggcgtcggtaatgaccgatgaagggctgatcgaccgcgacgtgatcctgttcaatcaccatgagtccccggcgctgtccgtcaaacccggtctgccgctggcgacagatgaaagctggctggatcaggaactcgacgaacgccagcgggtgattgctgcactggagaaaaccggctgggtgcaggccaaagcggcccgactgctgggcatgacaccgcgccagattgcctaccgtatccagattatggacatcaacatgcaccgtatctga

SEQ ID NO: 93 - DNA, 2838 bp, Rahnella aquatilis
  gene (1)..(2838): glnE
atgttgccactttcttctgttttgcaaagccacgcgcagagtttgcctgaacgctggcatgaacatcctgaaaacctgcccctccccgatgatgaacagctggctgtgctgagcagcagtgaattcatgacggacagtttgctggcttttccgcagtggtggcatgaaattgtccaaaatccccctcaggcgcaggagtggcaactttaccgtcagtggctggatgaatcgctgacgcaggtgactgacgaagccgggttaatgaaagctttgcgtctgttccgccgccgtattctgacccgcattgcgtggtcacagtccgcgcaaaccagcgaagcaaaagatacgcttcaccagctgagtgaactggcggaattattgattgtcagcgcccgtgactggctgtatgccgcttgctgtcgcgagttcggtacgccggtcaatgccgcaggggaaccgcagagaatgctgatcctcgggatgggcaaactcggcggtggcgagctgaatttctcatcggacatcgacctgatttttgcttatccggaaaatggccagacacgcggcggtcggcgtgaactggataacgcacaatttttcacccggctcggccagcgtctgatcaaagcgctggatcagcccactatcgacggttttgtctatcgcgtggacatgcgtttgcgtccgttcggcgacagtggcccgctggtgatgagcttcccggcactggaagattattatcaggaacaggggcgcgactgggaacgctacgcaatggtgaaagcgcgtctgatgggcggcgcggaggacatcagcagtcaggaattgcgtaaaatgctgatgccttttgtcttccgccgttatatcgatttcagtgtgatccagtccctgcgtaacatgaaaggcatgatcgcccgcgaagtacgccgccgtggtctgaaagacaacatcaaactcggcgcaggcggtattcgtgaaattgaatttatcgtgcaggtatttcagctgatccgtggcggtcgtgaaccggcattgcagcagcgtgcgttgttgccaacgcttcaggcgctggaaaatctggggctgctgccggtagagcaggtgttgcagttgcgtaacagctatctgttcctgcgacgtctggaaaacctgttgcaggccattgctgacgagcaaacgcaaaccttaccgtccgatgagctgaatcaggcgcgtctggcgtgggggatgaattacgctggctggccgcagcttctggatgcagtgaatgctcacatgcaggccgtacgcgcggtatttaacgatctgattggcgatgacacgccagatgccgaagatgacgtgcaactctcccggttcagcagtttatggattgatacgcttgagcctgacgagctggctccgctggtgccgcaacttgacgaaaatgcgcaacggcatgttttacatcagattgctgattttcgccgtgacgtggataaacgcacgatagggccacgtgggcgtgatcagttggatttgctgatgccgcgtttactggcccaggtctgcacctataaaaatgcggatgtgacgttacagcgcctgatgcagttgctgctcaatatcgtcacgcgcacgacgtatatcgagctgctggtggaatatcccggtgcgctcaaacagttaatacgtctgtgcgctgcctcgccgatggtggcgacgcaacttgcgcgtcatcctttattgctcgacgaactgctcgacccgcgcacgctttaccagccgattgagccgggcgcgtaccgtgatgaactgcggcaatatctgatgcgggtgccaaccgaagacgaagaacaacagcttgaagccgtgcgccagttcaaacaggcacagcatttacgtattgcggccggggatatttccggtgcgttgccggtgatgaaagtcagtgaccatttaacctaccttgcggaggccattctcgacgttgtggtgcaacaggcgtgggaacaaatggtcgtaaaatacggtcagccaacccatcttcagcaccgtaaagggcgcggttttgccgtggtgggttacggaaaactcggtggctgggagctgggttacagctcggatctggatctggtcttcctgctcgattgcgcgccggaagtcatgaccgacggcgaacgcagcattgacgggcgtcagttttatctgcggctggcgcagcgcatcatgcatttattcagcacccgtacgtcgtcaggcattctttatgaggttgacccgcgtctgcggccttccggtgcttccggcatgctggtcagcaccatcgaagcttttgcggattatcaggccaacgaagcctggacatgggagcatcaggcgctggttcgcgcgcgtgtggtttatggtgatccgcaactgacgcagcaatttaatgccacgcgtcgcgacattctttgccgccagcgcgatgccgacggcttgcgtaaggaagtccgtgaaatgcgcgagaaaatgtatgcccatctgggcagcaaaagagccgacgagtttgatctgaaagccgatccgggtggcataacggatattgaattcatcgcacaatatctggttctgcgtttcgcgcatgatgagccgaagctgacccgctggtctgataacgtgcggattttcgaactgatggcgcgacatgacatcatgccggaagaggaagcacgccatctgacgcaggcttacgtgacattgcgcgatgaaattcatcatctggcgttgcaggaacacagcgggaaagtggccgcagacagctttgccactgagcgcgcgcaaatccgcgccagctgggcaaactggcttggctga

SEQ ID NO: 94 - DNA, 1290 bp, Rahnella aquatilis
  gene (1)..(1290): amtB
atgaaaaaacttttatccatgatggggcttggtgcagtggctttgctaccttcgcttgccatggcagcagcaccagcagcggcaaacggtgctgataacgcctttatgatgatttgtaccgcgctggtattgttcatgaccgtacccggtgtggcgttgttctacggcggcttactgcgttctaaaaacgttttgtccatgctgactcaggttattgttacctttgctctggtctgcgtcctgtggatcctctacggttacagccttgccttcagtgaaggtaacgcgttcttcggtggtttcagcaacgtaatgatgaaaggcattggcctggattctgtgactggcaccttctcgcagatgatccacgttgcattccagtgttcatttgcctgcatcactgtagcgctgatcgtaggtggtattgctgaacgtgtgcgtttctcagcagttctgattttcactgtgatctggctgactttctcttatattccgatggctcacatggtatgggcaggcggtttcctggctgctgacggtgcgctggactttgccggtggtaccgttgttcatatcaatgccgcaattgctggcctggtaggggcttatctgctgggtaaacgcgccggttttggcaaagaagctttcaaaccacacaacctgccaatggtcttcactggcgcctcaatcctgtatgtgggctggttcggcttcaatgcgggttcagcaagtgccgcaagctctgttgccgcgctggctttcctgaacactgtcattgctactgctggcgcaatcctgtcctggacgctggttgagtggatggtgcgcggtaagccctcactgctgggcgcaagctccggtgctatcgcaggtctggtggctatcacgcctgcatgtggtacggtcggcgtaggtggtgctctgattatcggtctggtaggcggtatcactggtctgtggggggttgttaccctgaaaaaatggctgcgtgttgatgacacctgtgatgtgttcggtgttcatggcgtgtgcggtatcgtaggttgtctgctgacgggtgtattcacgtccagttcacttggcggcgtgggctacgcagaaggcgtgaccatgggccatcaggtttgggtgcagttcttcagcgtgtgcgtaacattggtctggtcaggcgttgttgccttcatcggttacaaagtggctgacatgatcgtaggtctgcgtgttcctgaagaacaagaacgcgaaggtctggacgttaacagccacggcgaaaacgcttacaaccaataa

SEQ ID NO: 95 - DNA, 500 bp, Rahnella aquatilis
  gene (1)..(500): PinfC
tgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatc

SEQ ID NO: 96 - DNA, 1085 bp, Klebsiella variicola
  gene (1)..(1085): 16S
attgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttggg

SEQ ID NO: 97 - DNA, 882 bp, Klebsiella variicola
  gene (1)..(882): nifH1
atgaccatgcgtcaatgcgctatctacggtaaaggcggtatcggtaaatccaccaccacccagaatctcgtcgcggccctcgccgagatgggtaagaaagtgatgatcgtcggctgcgatccgaaagcggattccacccgtctgatcctccacgctaaagcccagaacaccatcatggagatggcggcggaagtgggctcggtcgaggatctggagctcgaagacgttctgcaaatcggctatggcgatgtccgttgcgccgaatccggcggcccggagccaggcgtcggctgcgccggacgcggggtgatcaccgccatcaacttcctcgaggaagaaggcgcctatgaagaagatttggatttcgtcttctatgacgtcctcggcgacgtggtctgcggcggcttcgctatgccgatccgcgaaaacaaagcccaggagatctacatcgtctgctccggcgagatgatggcgatgtatgccgccaacaatatctccaaagggatcgtgaagtacgccaaatccggcaaggtgcgcctcggcggcctgatctgtaactcgcgcaaaaccgaccgggaagacgaactgatcatcgccctggcggagaagcttggcacgcagatgatccacttcgttccccgcgacaacattgtgcagcgcgcggagatccgccggatgacggtgatcgagtacgacccgacctgtcagcaggcgaatgaatatcgtcaactggcgcagaagatcgtcaataacaccaaaaaagtggtgccgacgccgtgcaccatggacgagctggaatcgctgctgatggagttcggcatcatggaagaagaagacaccagcatcattggtaaaaccgccgctgaagaaaacgcggcctga

SEQ ID NO: 98 - DNA, 1113 bp, Klebsiella variicola
  gene (1)..(1113): nifH2
atggttaggaaaagtagaagtaaaaatacaaatatagaactaactgaacatgaccatttattaataagtcaaataaaaaagcttaaaacacaaaccacttgcttttttaataataaaggaggggttgggaagactacattagtagcaaatttaggagcagagctatcaataaactttagtgcaaaagttcttattgtggatgccgaccctcaatgtaatctcacgcagtatgtattaagtgatgaagaaactcaggacttatatgggcaagaaaatccagatagtatttatacagtaataagaccactatcctttggtaaaggatatgaaagtgacctccctataaggcatgtagagaatttcggttttgacataattgtcggtgaccctagacttgctttacaggaagaccttttagctggagactggcgagatgccaaaggcggtgggatgcgaggaattaggacaacttttgtatttgcagagttaattaagaaagctcgtgagctaaattatgattttgttttctttgacatgggaccatcattaggcgcaatcaacagggcagtattactggcaatggaattctttgtcgtcccaatgtcaatcgatgtattttcactatgggctattaaaaatattggctccacggtttcaatatggaaaaaagaattagacacagggattcggctctcagaggaacctagcgaattatcacaattatcacctcaaggaaaactaaagtttctcggttacgtcacccaacaacataaagaacgctctggatacgatacaattcagcttgagaatactgaggaagaaataaaatcgaaacgtcgggtaaaggcgtatgaagacattggagaggtgtttccttctaaaattactgagcatctttctaaactttatgcatcaaaagatatgaacccacaccttggagatatacgtcatttaggtagtttagctccgaaatcacaatcacaacacgttccgatgatatcagtgtctggtacaggaaattacaccagacttagaaaaagcgcgcgtgaactttatcgagatattgcaagaagatacttagagaacattcagactgctaatggcgagaaatag

SEQ ID NO: 99 - DNA, 1374 bp, Klebsiella variicola
  gene (1)..(1374): nifD1
atgaagggaaaggaaattctggcgctgctggacgaacccgcctgcgagcacaaccagaagcaaaaatccggctgcagcgcccctaagcccggcgctaccgccggcggttgcgccttcgacggcgcgcagataacgctcctgcccatcgccgacgtcgcgcacctggtgcacggccccatcggctgcgcgggcagctcgtgggataaccgcggcagcgtcagcgccggcccggccctcaaccggctcggctttaccaccgatcttaacgaacaggatgtgattatgggccgcggcgaacgccgcctgttccacgccgtgcgtcacatcgtcgaccgctatcatccggcggcggtctttatctacaacacctgcgtaccggcgatggagggcgatgacatcgaggcggtctgccaggccgcacagaccgccaccggcgtcccggtcatcgctattgacgccgccggtttctacggcagtaaaaatcttggcaaccgaatggcgggcgacgtgatgctcaggcaggtgattggccagcgcgaaccggccccgtggccagacaacacgccctttgccccggcccagcgccacgatatcggcctgattggcgaattcaatatcgccggcgagttctggcaggtccagccgctgctcgacgagctggggatccgcgtcctcggcagcctctccggcgacggccgctttgccgagatccagaccctgcaccgggcgcaggccaatatgctggtgtgctcgcgcgcgctgatcaacgtcgcccgggggctggagctgcgctacggcacgccgtggtttgaaggcagcttctacgggatccgcgccacctccgacgccttgcgccagctggcgacgctgctgggggatgacgacctgcgccgccgcaccgaggcgctgatcgcccgcgaagagcaggcggcggagcaggctcttgcgccgtggcgtgagcagctccgcgggcgcaaagtgctgctctataccggcggcgtgaaatcctggtcggtggtatcggccctgcaggatctcggcatgaccgtggtggccaccggcacgcgcaaatccaccgaggaggacaaacagcggatccgtgagctgatgggcgacgaggcggtgatgcttgaggagggcaatgcccgcaccctgctcgacgtggtgtaccgctatcaggccgacctgatgatcgccggcggacgcaatatgtacaccgcctggaaagcccggctgccgtttctcgatatcaatcaggagcgcgagcacgcctacgccggctatcagggcatcatcaccctcgcccgccagctctgtctgaccctcgccagccccgtctggccgcaaacgcatacccgcgccccgtggcgctag

SEQ ID NO: 100 - DNA, 1449 bp, Klebsiella variicola
  gene (1)..(1449): nifD2
atgaccaacgcaacaggcgaacgtaaccttgcgctcatccaggaagtcctggaggtgtttcccgaaaccgcgcgcaaagagcgcagaaagcacatgatgatcagcgatccgcagatggagagcgtcggcaagtgcattatctcgaaccgtaaatcgcagcccggggtgatgaccgtgcgcggctgcgcctatgcgggctcgaaaggggtggtgtttgggccaatcaaagacatggcccatatctcgcacggccccatcggctgcggccagtattcccgcgccggacggcgcaactactataccggcgtcagcggtgtcgacagcttcggcaccctgaacttcacctctgattttcaggagcgcgatattgttttcggcggcgataaaaagctgaccaaactgatcgaagagatggagctgctgttcccgctgaccaaagggatcaccatccagtcggagtgcccggtgggcctgatcggcgatgacatcagcgccgtagccaacgccagcagcaaggcgctggataaaccggtgatcccggtgcgctgcgaaggctttcgcggcgtatcgcaatcgctgggccaccatatcgccaacgacgtggtgcgcgactgggtgctgaacaatcgcgaagggcagccgtttgccagcaccccgtacgatgttgccatcattggcgattacaacatcggcggcgacgcctgggcctcgcgcattctgctggaagagatggggctgcgcgtagtggcgcagtggtccggcgacggcaccctggtggagatggagaacaccccattcgttaagcttaacctcgtccactgctaccgttcgatgaactatatcgcccgccatatggaggagaaacatcagatcccatggatggaatataacttcttcggcccgaccaaaatcgccgaatcgctgcgcaagatcgccgatcaatttgatgacaccattcgcgccaatgcggaagcggtgatcgccaaatatgaggggcagatggcggccatcatcgccaaatatcgcccgcggctggaggggcgcaaagtgctgctgtacatgggggggctgcggccgcgccacgtcatcggcgcctatgaggatctcgggatggagatcatcgccgccggctacgagtttgcccataacgatgattacgaccgcaccctgccggacctgaaagagggcaccctgctgtttgacgatgccagcagctatgagctggaggccttcgtcaaagcgctgaaacctgacctcatcggctccgggatcaaagagaaatatatcttccagaaaatgggggtgccgttccgccagatgcactcctgggactattccggcccctatcacggctatgacggcttcgccatctttgcccgcgatatggatatgaccctgaacaatccggcgtggaacgaactgactgccccgtggctgaagtctgcgtga

SEQ ID NO: 101 - DNA, 1386 bp, Klebsiella variicola
  gene (1)..(1386): nifK1
atggcagatattatccgcagtgaaaaaccgctggcggtgagcccgattaaaaccgggcaaccgctcggggcgatcctcgccagcctcgggctggcccaggccatcccgctggtccacggcgcccagggctgcagcgccttcgccaaagttttctttattcagcatttccatgacccggtgccgctgcagtcgacggccatggatccgaccgccacgatcatgggggccgacggcaatatcttcaccgcgctcgacaccctctgccagcgccacagcccgcaggccatcgtgctgctcagcaccggtctggcggaagcgcagggcagcgatatcgcccgggtggtgcgccagtttcgcgaggcgcatccgcgccataacggcgtggcgatcctcaccgtcaataccccggatttttttggctctatggaaaacggctacagcgcggtgatcgagagcgtgatcgagcagtgggtcgcgccgacgccgcgtccggggcagcggccccggcgggtcaacctgctggtcagccacctctgttcgccaggggatatcgaatggctgggccgctgcgtggaggcctttggcctgcagccggtgatcctgccggacctctcgcagtcaatggatggccacctcggtgaaggggattttacgcccctgacccagggcggcgcctcgctgcgccagattgcccagatgggccagagtctgggcagcttcgccattggcgtgtcgctccagcgggcggcatcgctcctgacccaacgcagccgcggcgacgtgatcgccctgccgcatctgatgaccctcgaccattgcgatacctttatccatcagctggcgaagatgtccggacgccgcgtaccggcctggattgagcgccagcgtggccagctgcaggatgcgatgatcgactgccatatgtggcttcagggccagcgcatggcgatggcggcggagggcgacctgctggcggcgtggtgtgatttcgcccgcagccaggggatgcagcccggcccgctggtcgcccccaccagccaccccagcctgcgccagctgccggtcgagcaagtcgtgccgggggatcttgaggatctgcagcagctgctgagccaccaacccgccgatctgctggtggctaactctcacgcccgcgatctggcggagcagtttgccctgccgctgatccgcgtcggttttcccctcttcgaccggctcggtgagtttcgtcgcgtccgccaggggtacgccggtatgcgagatacgctgtttgaactggccaatctgctgcgcgaccgccatcaccacaccgccctctaccgctcgccgcttcgccagggcgccgacccccagccggcttcaggagacgcttatgccgcccattaa

SEQ ID NO: 102 - DNA, 1563 bp, Klebsiella variicola
  gene (1)..(1563): nifK2
atgagccaaacgatcgataaaattcacagctgttatccgctgtttgaacaggatgaataccagaccctgttccagaataaaaagacccttgaagaggcgcacgacgcgcagcgtgtgcaggaggtttttgcctggaccaccaccgccgagtatgaagcgctgaacttccagcgcgaggcgctgaccgtcgacccggccaaagcctgccagccgctcggcgccgtactctgcgcgctggggttcgccggcaccctgccctacgtgcacggctcccagggctgcgtcgcctattttcgcacctactttaaccgccattttaaagagccggtcgcctgcgtctccgactccatgaccgaggacgcggcggtgttcggcggcaacaacaacatgaatctgggcctgcagaatgccagcgcgctgtataaacccgagattatcgccgtctccaccacctgtatggccgaggtgatcggcgacgatctgcaggcgtttatcgccaacgccaaaaaagagggatttgttgacgaccgcatcgccattccttacgcccatacccccagctttatcggcagccatgtcaccggctgggacaatatgttcgaagggttcgcgaagacctttaccgctgactacgccgggcagccgggcaaacagcaaaagctcaatctggtgaccggatttgagacctatctcggcaacttccgcgtgctgaagcggatgatggcgcagatggatgtcccgtgcagcctgctctccgacccatcagaggtgctcgacacccccgccgacggccattaccggatgtacgccggcggcaccagccagcaggagatcaaaaccgcgccggacgccattgacaccctgctgctgcagccgtggcagctggtgaaaagcaaaaaggtggttcaggagatgtggaaccagcccgccaccgaggtggccgttccgctgggcctggccgccaccgacgcgctgctgatgaccgtcagtcagctgaccggcaaaccgatcgccgacgctctgaccctggagcgcggccggctggtcgacatgatgctggattcccacacctggctgcatggcaaaaaattcggcctctacggcgatccggatttcgtgatggggctgacgcgcttcctgctggagctgggctgcgagccgacggtgatcctcagtcataacgccaataaacgctggcaaaaagcgatgaagaaaatgctcgatgcctcgccgtacggtcaggaaagcgaagtgttcatcaactgcgacctgtggcacttccggtcgctgatgttcacccgtcagccggactttatgatcggtaactcctacggcaagtttatccagcgcgataccctggcaaagggcaaagccttcgaagtgccgctgatccgtctgggctttccgctgttcgaccgccatcatctgcaccgccagaccacctggggctatgaaggcgcaatgaacatcgtcacgacgctggtgaacgccgtgctggaaaaactggaccacgacaccagccagttgggcaaaaccgattacagcttcgacctcgttcgttaa

SEQ ID NO: 103 - DNA, 1485 bp, Klebsiella variicola
  gene (1)..(1485): nifL
atgaccctgaatatgatgctcgataacgccgcgccggaggccatcgccggcgcgctgactcaacaacatccggggctgttttttaccatggtggaacaggcctcggtggccatctccctcaccgatgccagcgccaggatcatttacgccaacccggcgttttgccgccagaccggctattcgctggcgcaattgttaaaccagaacccgcgcctgctggccagcagccagacgccgcgcgagatctatcaggagatgtggcataccctgctccagcgtcagccctggcgcggtcagctgattaatcagcgtcgggacggcggcctgtacctggtggagattgacatcaccccggtgcttagcccgcaaggggaactggagcattatctggcgatgcagcgggatatcagcgtcagctacaccctcgaacagcggctgcgcaaccatatgaccctgatggaggcggtgctgaataatatccccgccgccgtggtagtggtggacgagcaggatcgggtggtgatggacaacctcgcctacaaaaccttctgcgctgactgcggcggccgggagctgctcaccgagctgcaggtctcccctggccggatgacgcccggcgtggaggcgatcctgccggtggcgctgcgcggggccgcgcgctggctgtcggtaacctgctggccgttgcccggcgtcagtgaagaggccagccgctactttatcgacagcgcgctggcgcggaccctggtggtgatcgccgactgtacccagcagcgtcagcagcaggagcaagggcgccttgaccggctgaagcagcaaatgaccgccggcaagctgctggcggcgatccgcgagtcgctggacgccgcgctgatccagctgaactgcccgattaatatgctggcggcagcccgtcggctgaacggcgagggaagcgggaatgtggcgctggaggccgcctggcgtgaaggggaagaggcgatggcgcggctccagcgctgtcgcccatcgctggaactcgaaaaccccgccgtctggccgctgcagccctttttcgacgatctgtgcgccctctaccgtacacgcttcgatcccgacgggctgcaggtcgacatggcctcaccgcatctgatcggctttggccagcgcaccccactgctggcgtgcttaagcctgtggctcgatcgcaccctggccctcgccgccgaactcccctccgtgccgctggcgatgcagctctacgccgaggagaacgacggctggctgtcgctgtatctgactgacaacgtaccgctgctgcaggtgcgctacgctcactcccccgacgcgctgaactcgccgggcaaaggcatggagctgcggctgatccagaccctggtggcgcaccatcgcggggccattgagctggcttcccgaccgcagggcggcacctgcctgaccctgcgtttcccgctgtttaacaccctgaccggaggtgaagcatga

SEQ ID NO: 104 - DNA, 1575 bp, Klebsiella variicola
  gene (1)..(1575): nifA
atgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtacgcggcgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctactatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttatcggatccagatcatggatatcaccctgccgcgtctgtag

SEQ ID NO: 105 - DNA, 2838 bp, Klebsiella variicola
  gene (1)..(2838): glnE
atgatgccgctttctccgcaattacagcagcactggcagacggtcgctgaccgtctgccagcggattttcccattgccgaactgagcccacaggccaggtcggtcatggcgttcagcgattttgtcgaacagagtgtgatcgcccagccgggctggctgaatgagcttgcggactcctcgccggaggcggaagagtggcggcattacgaggcctggctgcaggatcgcctgcaggccgtcactgacgaagcggggttgatgcgagagctgcgtctcttccgccgccagatgatggtccgcatcgcctgggcgcaggcgctgtcgctggtgagcgaagaagagactctgcagcagctgagcgtcctggcggagaccctgattgtcgccgcccgcgactggctgtacgccgcctgctgtaaggagtggggaacgccatgcaatgccgagggccagccgcagccgctgctgatcctcgggatgggaaagctgggcggcggcgagctgaacttctcttccgatatcgatctgatctttgcctggcctgagcatggcgccacccgcggcggccgccgcgagctggataacgcccagttctttacccgtctggggcagcggctgatcaaggcccttgaccagccgacgcaggacggctttgtctatcgggttgacatgcgcctgcggccgtttggcgacagtgggccgctggtactcagttttgcggcgctggaagattattaccaggagcagggtcgggactgggaacgctatgcgatggtgaaagcgcggatcatgggcgataacgacggcgtgtacgccagcgagttgcgcgcgatgctccgtcctttcgtcttccgccgttatatcgacttcagcgtgatccagtcgctgcgtaacatgaaaggcatgatcgcccgcgaagtgcggcgtcgcgggctgaaagacaacatcaagctcggcgccggcgggatccgtgaaattgagtttatcgttcaggtctttcaactgatccgcggtggtcgcgaacctgcactgcagcagcgcgccctgctgccgacgctggcggcgattgatgagctacatctgctgccggaaggcgacgcggcgctgctgcgcgaggcctatctgttcctgcgccggctggaaaacctgctgcaaagcatcaacgatgagcagacccagaccctgccgcaggatgaacttaaccgcgccaggctggcgtgggggatgcataccgaagactgggagacgctgagcgcgcagctggcgagccagatggccaacgtgcggcgagtgtttaatgaactgatcggcgatgatgaggatcagtccccggatgagcaactggccgagtactggcgcgagctgtggcaggatgcgctggaagaagatgacgccagcccggcgctggcgcatttaaacgataccgaccgccgtagcgtgctggcgctgattgccgattttcgtaaagagctggatcggcgcaccatcggcccgcgcggccgccaggtgctggatcagctgatgccgcatctgctgagcgaaatctgctcgcgcgccgatgcgccgctgcctctggcgcggatcacgccgctgttgaccgggatcgtcacccgtaccacctatcttgagctgctgagcgaattccccggcgcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 106 - DNA, 500 bp, Klebsiella variicola
  gene (1)..(500): PinfC
agcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgc

SEQ ID NO: 107 - DNA, 1287 bp, Klebsiella variicola
  gene (1)..(1287): amtB
atgaaaatggcaacaatgaaatcgggtctgggggcattagcccttcttccgggactggcaatggccgcgcccgcagtggcggacaaagccgataacgcgtttatgatgatttgcaccgcgctggttctgtttatgaccatcccggggatcgcgctgttttacggcggcctgatccgcggcaaaaacgtcctttccatgctgactcaggtgattgtgacctttggcctggtctgcgtactgtgggtgatttatggctataccctggccttcggcaccggcggcagcttcttcggtagttttgactgggtgatgctgaaaaatattgaactgaaagcgctgatgggcaccttctatcagtacatccacgtggccttccagggctcgttcgcctgtatcaccgtcgggctgatcgtgggggcgctggctgagcgtattcgtttctccgccgtgctgatttttgtggtggtgtggatgacgctctcttatgttccgattgcgcacatggtctggggcggcggtctgctggcgacccacggcgcgctggacttcgcgggcggcaccgttgtacacatcaacgccgcggttgccgggctggtgggtgcgtacatgatgggcaaacgtgtgggcttcggcaaagaagcgttcaaaccgcacaatctgccgatggtgttcaccggaaccgccatcctctacgtgggctggttcggcttcaacgccggctccgccagcgcagcgaacgaaattgccgcattggctttcgtcaacaccgtcgtcgccacagcggctgccatcctggcgtggacctttggcgaatgggccctgcgcggtaaaccttcactgctgggcgcctgctccggggcgattgccggtctggttggcgtcacaccagcctgtgggtatatcggtgtcggtggggcgttgattgtgggtatcgcatctggtctggcgggcatctggggcgtaacggcgctgaaacgctggctgcgggttgatgacccttgcgacgtcttcggcgtccacggcgtctgcggcatcgtcggctgtatcctgaccggtatcttcgcggccacctctctgggcggcgtgggttatgcagaaggcgtcaccatgggccatcagctgctggtgcaactcgagagtatcgcgattaccatcgtctggtcgggcgttgtcgctttcattggctacaaagtggcggacatgaccgtggggctgcgcgtaccagaagagcaggagcgcgaaggactggacgtcaacagccatggcgaaaacgcctacaacgcctga

SEQ ID NO: 108 - DNA, 299 bp, Klebsiella variicola
  gene (1)..(299): Prm8.2
cgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatc

SEQ ID NO: 109 - DNA, 300 bp, Klebsiella variicola
  gene (1)..(300): Prm6.2
gctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttgga

SEQ ID NO: 110 - DNA, 400 bp, Klebsiella variicola
  gene (1)..(400): Prm1.2
gcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttg

SEQ ID NO: 111 - DNA, 1536 bp, Klebsiella variicola
  gene (1)..(1536): 16S
  misc_feature (245)..(245): n is a, c, t, g, unknown or other
  misc_feature (452)..(452): n is a, c, t, g, unknown or other
  misc_feature (454)..(454): n is a, c, t, g, unknown or other
  misc_feature (1131)..(1132): n is a, c, t, g, unknown or other
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctngtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgntnaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtnnggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 112 - DNA, 882 bp, Klebsiella variicola
  gene (1)..(882): nifH
atgaccatgcgtcaatgcgctatctacggtaaaggcggtatcggtaaatccaccaccacccagaatctcgtcgcggccctcgccgagatgggtaagaaagtgatgatcgtcggctgcgatccgaaagcggactccacccgtctgatccttcacgctaaagcccagaacaccatcatggagatggcggcggaagtgggctcggtcgaggatctggagctcgaagacgttctgcaaatcggctatggcgatgtccgttgcgccgaatccggcggcccggagccaggcgtcggctgcgccggacgcggggtgatcaccgccatcaacttcctcgaggaagaaggcgcctatgaggaagatttggatttcgtcttctatgacgtcctcggcgacgtagtctgcggcggcttcgccatgccgatccgcgaaaacaaagcccaggagatctacatcgtctgctccggcgagatgatggcgatgtatgccgccaacaatatctccaaggggatcgtgaagtacgcgaaatctggcaaggtgcgcctcggcggcctgatctgtaactcgcgcaaaaccgaccgggaagacgaactgatcatcgccctggcggagaagcttggcacgcagatgatccacttcgttccccgcgacaacattgtgcagcgcgcggagatccgccggatgacggtgatcgagtacgacccgacctgtcagcaggcgaatgaatatcgtcaactggcgcagaagatcgtcaataacaccaaaaaagtggtgccaacgccgtgcaccatggacgagctggaatcgctgctgatggagttcggcatcatggaagaagaagacaccagcatcattggtaaaaccgccgctgaagaaaacgcggcctga

SEQ ID NO: 113 - DNA, 1449 bp, Klebsiella variicola
  gene (1)..(1449): nifD1
atgaccaacgcaacaggcgaacgtaaccttgcgctcatccaggaagtcctggaggtgtttcccgaaaccgcgcgcaaagagcgcagaaagcacatgatgatcagcgatccgcagatggagagcgtcggcaagtgcattatctcgaaccgtaaatcgcagcccggggtgatgaccgtgcgtggctgcgcctatgcgggctcgaaaggggtggtgtttgggccaatcaaagacatggcccatatctcgcacggccccatcggctgcggccagtactcgcgcgccggacggcgcaactactataccggcgtcagcggtgtcgacagcttcggcaccctgaacttcacctctgattttcaggagcgcgatattgttttcggcggcgataaaaagctgaccaaactgatcgaagagatggagctgctgttcccgctgaccaaagggatcaccatccagtcggagtgcccggtgggcctgatcggcgatgacatcagcgccgtggccaacgccagcagcaaggcgctggataaaccggtgatcccggtgcgctgcgaaggctttcgcggcgtatcgcaatcgctgggccaccatatcgccaacgacgtggtgcgcgactgggtgctgaacaatcgcgaagggcagccgtttgccagcaccccgtatgatgttgccatcattggcgattacaacatcggcggcgacgcctgggcctcgcgcattctgctggaagagatggggctgcgcgtagtggcgcagtggtccggcgacggcaccctggtggagatggagaacaccccattcgttaagcttaacctcgtccactgctaccgttcgatgaactatatcgcccgccatatggaggagaaacatcagatcccgtggatggaatataacttcttcggcccgaccaaaatcgccgaatcgctgcgcaagatcgccgatcaatttgatgacaccattcgcgccaatgcggaagcggtgatcgccaaatatgaggggcagatggcggccatcatcgccaaatatcgcccgcggctggaggggcgcaaagtgctgctgtacatgggggggctgcggccgcgccacgtcatcggcgcctatgaggatctcgggatggagatcatcgccgccggctacgagtttgcccataacgatgattacgaccgcaccctgccggacctgaaagagggcaccctgctgtttgacgatgccagcagctatgagctggaggccttcgtcaaagcgctgaaacctgacctcatcggctccgggatcaaagagaaatatatcttccagaaaatgggggtgccgttccgccagatgcactcctgggactattccggcccctatcacggctatgacggcttcgccatctttgcccgcgatatggatatgaccctgaacaatccggcgtggaacgaactgactgccccgtggctgaagtctgcgtga

SEQ ID NO: 114 - DNA, 1374 bp, Klebsiella variicola
  gene (1)..(1374): nifD2
atgaagggaaaggaaattctggcgctgctggacgaacccgcctgcgagcacaaccagaagcaaaaatccggctgcagcgctcctaagcccggcgcaaccgccggcggctgcgccttcgacggcgcgcagataacgctcctgcccatcgccgacgtcgcgcacctggtgcacggccccatcggctgcgcgggcagctcgtgggataaccgcggcagcgtcagcgccggcccggccctcaaccggctcggctttaccaccgatcttaacgaacaggatgtgattatgggccgcggcgaacgccgcctgttccacgccgtccgtcacatcgtcgaccgctatcatccggcggcggtctttatctacaacacctgcgtaccggcgatggagggggatgacctggaggccgtctgccaggccgcacagaccgccaccggcgtcccggtcatcgccattgacgccgccggtttctacggcagtaaaaatcttggcaaccgaatggcgggcgacgtgatgctcaggcaggtgattggccagcgcgaaccggccccgtggccagacaacacgccctttgccccggcccagcgccacgatatcggcctgattggcgaattcaatatcgccggcgagttctggcaggtccagccgctgctcgacgagctggggatccgcgtcctcggcagcctctccggcgacggccgctttgccgagatccagaccctgcaccgggcgcaggccaatatgctggtgtgctcgcgcgcgctgatcaacgtcgcccgggggctggagctgcgctacggcacgccgtggtttgaaggcagcttctacgggatccgcgccacctccgacgccttgcgccagctggcggcgctgctgggggatgacgacctgtgccgccgcaccgaggcgctgatcgcccgcgaagagcaggcggcggagcaggcgctggcgccgtggcgcgagcagctccgtgggcgcaaagtgttgctctacaccggcggcgtgaaatcctggtcggtggtatcagccctgcaggatctcggcatgaccgtggtggccaccggcacgcggaaatccaccgaggaggacaaacagcggatccgtgagctgatgggcgacgaggcggtgatgcttgaggagggcaatgcccgcaccctgctcgacgtggtgtaccgctatcaggccgacctgatgatcgccggcggacgcaatatgtacaccgcctggaaagcccggctgccgtttctcgatatcaatcaggagcgcgagcacgcctacgccggctatcagggcatcatcaccctcgcccgccagctctgtctgaccctcgccagtcccgtctggccgcaaacgcatacccgcgccccgtggcgctag

SEQ ID NO: 115 - DNA, 1386 bp, Klebsiella variicola
  gene (1)..(1386): nifK1
atggcagacattatccgcagtgaaaaaccgctggcggtgagcccgattaaaaccgggcaaccgctcggggcgatcctcgccagcctcgggctggcccaggccatcccgctggtccacggcgcccagggctgcagcgccttcgccaaagttttctttattcagcatttccatgacccggtgccgctgcagtcgacggccatggatccgaccgccacgatcatgggggccgacggcaatatcttcaccgcgctcgacaccctctgccagcgccacagcccgcaggccatcgtgctgctcagcaccggtctggcggaagcgcagggcagcgatatcgcccgggtggtgcgccagtttcgtgaggcgcatccgcgccataacggcgtggcgatcctcaccgtcaataccccggatttttttggctcgatggaaaacggctacagcgcggtgatcgagagcgtgatcgagcagtgggtcgcgccgacgccgcgtccggggcagcggccccggcgggtcaacctgctggtcagccacctctgttcgccaggggatatcgaatggctgggccgctgcgtggaggcctttggcctgcagccggtgatcctgccggacctctcgcagtcaatggatggccacctcggtgaaggggattttacgcccctgacccagggcggcgcctcgctgcgccagattgcccagatgggccagagtctgggcagcttcgccattggcgtgtcgctccagcgggcggcatcgctcctgacccaacgcagccgcggcgacgtgatcgccctgccgcatctgatgaccctcgaccattgcgatacctttatccatcagctggcgaagatgtccggacgccgcgtaccggcctggattgagcgccagcgcggccagctgcaggatgcgatgatcgactgccatatgtggcttcagggccagcgcatggcgatggcggcggagggcgacctgctggcggcgtggtgtgatttcgcccgcagccaggggatgcagcccggcccgctggtcgcccccaccagccaccccagcctgcgccagctgccggtcgatcaggtcgtgccgggggatcttgaggatctgcagcagctgctgagccaccaacccgccgatctgctggtggctaactctcacgcccgcgatctggcggagcagtttgccctgccgctgatccgcgtcggttttcccctcttcgaccggctcggtgagtttcgtcgcgtccgccaggggtacgccggtatgcgagatacgctgtttgagctggccaatctgctgcgcgaccgccatcaccacaccgccctctaccgctcgccgcttcgccagggcgccgaccccctgccggcttcaggagacgcttatgccgcccattaa

SEQ ID NO: 116 - DNA, 183 bp, Klebsiella variicola
  gene (1)..(183): nifK2
gtgccgctgatccgtctgggctttccgctgttcgaccgccatcatctgcaccgccagaccacctggggctatgaaggcgcaatgaacatcgtcacgacgctggtgaacgccgtgctggaaaaactggaccacgacaccagccagttgggcaaaaccgattacagcttcgacctcgttcgttaa

SEQ ID NO: 117 - DNA, 1485 bp, Klebsiella variicola
  gene (1)..(1485): nifL
atgaccctgaatatgatgctcgataacgccgcaccggaggccatcgccggcgcgctgactcaacaacatccggggctgttttttaccatggtggaacaggcctcggtggccatatccctcaccgatgccagcgccaggatcatttacgccaacccagcgttttgccgccagaccggctattcgctggcgcaattgttaaaccagaacccgcgcctgctggccagcagccagacgccgcgcgcgatctatcaggagatgtggcataccctgctccagcgtcagccctggcgcggtcagctgattaatcagcgtcgggacggcggcctgtgcctggtggagattgacatcaccccggtgcttagcccgcaaggggaactggagcattatctggcgatgcagcgggatatcagcgtcagctacaccctcgaacaacggctgcgcaaccatatgaccctgatggaggcggtgctgaataatatccccgccgccgtggtggtggtggacgagcaggatcgggtggtgatggacaacctcgcctacaaaaccttctgcgctgactgcggcggccgggagctgctcaccgagctgcaggtctcccctggccggatgacgcccggcgtggaggcgatcctgccggtagcgctgcgcggggccgcgcgctggctgtcggtaacctgctggccgttgcccggcgtcagtgaagaggccagccgctactttatcgacagcgcgctggcgcggaccctggtggtgatcgccgactgtacccagcagcgtcagcagcaggagcaaggacgccttgaccggctgaagcagcaaatgaccgccggcaagctgctggcggcgatccgcgagtcgctggacgccgcgctgatccagctgaactgcccgattaatatgctggcggcagcccgtcggctgaacggcgagggaagcgggaatgtggcgctggaggccgcctggcgtgaaggggaagaggcgatggcgcggctccagcgctgtcgcccatcgctggaactcgaaaaccccgccgtctggccgctgcagccctttttcgacgatctgtgcgccctctaccgtacccgcttcgatcccgacgggctgcaggtcgacatggcctcaccgcatctgatcggctttggccagcgcaccccgctgctggcgtgcttaagcctgtggctcgaccgcaccctggccctcgccgccgaattgccctccgtgccgctggcgatgcagctctatgccgaggagaacgacggctggctgtcgctgtacctgactgataacgtaccgctgttgcaggtgcgctacgcccactcccccgacgcgctgaactcgccgggtaaaggcatggagctgcggctgatccagaccctggtggcgcaccatcgcggggccattgagctggcttcccgaccgcagggcggcacctgcctgaccctgcgtttcccgctgtttaacaccctgaccggaggtgaagcatga

SEQ ID NO: 118 - DNA, 1575 bp, Klebsiella variicola
  gene (1)..(1575): nifA
atgatccctgaatccgacccggacaccaccgtcagacgcttcgacctctctcagcagttcaccgccatgcagcggataagcgtggtgctgagccgggccaccgaggccagcaaaacgctgcaggaggtactcactgtattgcacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtgcgcggtgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctattatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttaccggatccagatcatggatatcaccctgccgcgtctgtag

SEQ ID NO: 119 - DNA, 2838 bp, Klebsiella variicola
  gene (1)..(2838): glnE
atgatgccgctttctccgcaattacagcagcactggcagacggtcgctgaccgtctgccagcggattttcccattgcagaactgagcccacaggccaggtcggtcatggcgttcagcgattttgtcgaacagagtgtgatcgcccagccgggctggctgaatgagcttgcggactcctcgccggaggcggaagagtggcggcattacgaggcctggctgcaggatcgcctgcaggccgtcactgacgaagcggggttgatgcgagagctgcgtctcttccgccgccagatgatggtccgcatcgcctgggcgcaggcgctgtcgctggtgagcgaagaagagaccctgcagcagctgagcgccctggcggagaccctgattgtcgccgcccgcgactggctctacgccgcctgctgtaaggagtggggaacgccatgcaatgccgagggccagccgcagccgctgctgatcctcgggatgggaaagctgggcggcggcgagctgaacttctcttccgatatcgatctgatctttgcctggcctgagcatggcgccacccgcggcggccgccgcgagctggataacgcccagttctttacccgtctggggcagcggctgatcaaggcccttgaccagccgacgcaggacggctttgtctatcgggttgacatgcgcctgcggccgtttggcgacagtgggccgctggtactcagctttgcggcactggaagattattaccaggagcagggtcgggactgggaacgctatgcgatggtgaaagcgcggatcatgggcgataacgacggcgtgtacgccagcgagttgcgcgcgatgctccgtcctttcgtcttccgccgttatatcgacttcagcgtgatccagtcgctgcgtaacatgaaaggcatgatcgcccgcgaagtgcggcgtcgcgggctgaaagacaacatcaagctcggcgccggcgggatccgtgaaattgagtttatcgttcaggtctttcagctgatccgcggtggtcgcgaacctgcactgcagcagcgcgccctgctgccgacgctggcggcgattgatgagctacatctgctgccggaaggcgacgcggcgctgctgcgcgaggcctatctgttcctgcgccggctggaaaacctgctgcaaagcatcaacgatgaacagacccagaccctgccgcaggatgaacttaaccgcgccaggctggcgtgggggatgcataccgaagactgggagacgctgagcgcgcagctggcgagccagatggccaacgtgcggcgagtgtttaatgaactgatcggcgatgatgaggatcagtccccggatgagcaactggccgagtactggcgcgagctgtggcaggatgcgctggaagaagatgacgccagcccggcgctggcgcatttaaacgataccgaccgccgtagcgtgctggcgctgattgccgattttcgtaaagagctggatcggcgcaccatcggcccgcgcggccgccaggtgctggatcagctgatgccgcatctgctgagcgaaatctgctcgcgtgccgatgcgccgctgcctctggcgcggatcacgccgctgttgaccgggatcgtcacccgtaccacctatcttgagctgctgagcgaattccccggcgcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggtcagccgacccacctgcacgatcgccagggtcgcggcttcgccgttgtcggctacggtaagctcggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggacgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcatacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 120 - DNA, 1287 bp, Klebsiella variicola
  gene (1)..(1287): amtB
atgaaaatggcaacaatgaaatcgggtctgggggcattagcccttcttccgggactggcaatggccgcgcccgcagtggcggacaaagccgataacgcgtttatgatgatttgcaccgcgctggttctgtttatgaccatcccggggatcgcgctgttttacggcggcctgatccgcggcaaaaacgtcctttccatgctgactcaggtgattgtgacctttggcctggtctgcgtactgtgggtgatttatggctataccctggccttcggcaccggcggcagcttcttcggtagctttgactgggtgatgctgaaaaatattgaactgaaagcgctgatgggcaccttctatcagtacatccacgtggccttccagggctcgttcgcctgtatcaccgtcgggctgatcgtgggggcgctggctgagcgtattcgtttctccgccgtgctgattttcgtggtggtgtggatgacgctctcttatgttccgattgcgcacatggtctggggcggcggtctgctggcgacccacggcgcgctggacttcgcgggcggcaccgttgtacacatcaacgccgcggttgccgggctggtgggtgcgtatatgatgggcaaacgtgtgggcttcggcaaagaagcgttcaaaccgcacaatctgccgatggtgttcaccggaaccgccatcctctacgtgggctggttcggcttcaacgccggctccgccagcgcagcgaacgaaattgccgcactggctttcgtcaacaccgtcgtcgccacagcggcagccatcctggcctggacctttggcgaatgggctctgcgcggcaaaccttcactgctgggcgcctgctccggggcgattgccggtctggttggcgtcacaccagcctgtgggtatatcggtgtcggtggggcgttgattgtgggtatcgcatctggtctggcgggcatctggggcgtaacggcgctgaaacgctggctgcgggttgatgacccttgcgacgtcttcggcgtccacggcgtctgcggcatcgtcggctgtatcctgaccggtatcttcgcggccacctctctgggcggcgtgggttatgcagaaggcgtcaccatgggccatcagctgctggtgcaactcgagagtatcgcgattaccatcgtctggtcgggcgttgtcgctttcattggctacaaagtggcggacatgaccgtggggctgcgcgtaccagaagagcaggagcgcgaaggactggacgtcaacagccatggcgaaaacgcctacaacgcctga

SEQ ID NO: 121 - DNA, 1435 bp, Achromobacter spiritinus
  gene (1)..(1435): 16S
  misc_feature (255)..(255): n is a, c, t, g, unknown or other
  misc_feature (454)..(454): n is a, c, t, g, unknown or other
ctgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaanggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggntaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattctgaagagattcggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaacc

SEQ ID NO: 122 - DNA, 1528 bp, Achromobacter marplatensis
  gene (1)..(1528): 16S
  misc_feature (255)..(255): n is a, c, t, g, unknown or other
  misc_feature (999)..(999): n is a, c, t, g, unknown or other
  misc_feature (1009)..(1009): n is a, c, t, g, unknown or other
  misc_feature (1437)..(1437): n is a, c, t, g, unknown or other
ctgaagagtttgatcctggctcagattgaacgctagcgggatgccttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaanggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcngaagagattnggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgnaaggggggcgattaccacggtaggattcatgactggggtgaagtcgtaacaaggtagccgtatcggaaggtgcggctggatcacctccttt

SEQ ID NO: 123 - DNA, 1522 bp, Microbacterium murale
  gene (1)..(1522): 16S
tacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtggccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctccttt

SEQ ID NO: 124 - DNA, 1537 bp, Kluyvera intermedia
  gene (1)..(1537): 16S
  misc_feature (455)..(455): n is a, c, t, g, unknown or other
  misc_feature (1004)..(1004): n is a, c, t, g, unknown or other
attgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatncggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattnggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 125 - DNA, 882 bp, Kluyvera intermedia
  gene (1)..(882): nifH
atgaccatgcgtcaatgcgccatttatggcaaaggtgggatcggcaaatccaccaccacgcaaaacctcgtcgccgctctcgcggaaatgggtaaaaaagtgatgatcgtcggctgcgacccgaaagcggactccacccgtctgatcctgcatgcgaaagcacagaacaccattatggagatggccgccgaagtgggttcagtggaagaccttgaactggaagatgtgctgcaaatcggttacggcggcgtgcgttgtgcagaatccggcggcccggagccaggcgtgggttgtgcaggccgcggcgttattaccgccattaacttccttgaagaagaaggcgcctatgtcagcgacctcgactttgtcttctatgacgtcctcggtgacgtggtctgcggcgggttcgccatgccgattcgtgaaaacaaagcgcaagagatctatatcgtctgctccggggaaatgatggcgatgtatgccgctaacaacatctccaaaggcatcgtgaaatacgctaaatccggcaaggtgcgcctgggcgggctgatttgtaactcccgtcagaccgaccgcgaagatgaactgatcatcgcgctggcagaaaaactgggcacccagatgattcactttgtgccacgcgacaacatcgtccagcgcgcggaaattcgccgtatgacggttatcgaatatgacccgaaatgcaaccaggccgacgaataccgcgcgctggcgaacaagatcgtcaacaacaccctgatggtcgtcccgaccccttgcaccatggatgaactggaagagctgctgatggaattcggcattatggatgtggaagacgccagcatcatcggtaaaaccgccgccgaagaaaacgcggcctga

SEQ ID NO: 126 - DNA, 660 bp, Kluyvera intermedia
  misc_feature (1)..(660): Dinitrogenase iron-molybdenum cofactor coding sequence
atgaacgataacgatgtccttttctggcgcatgctggcgctatttcagtgtctgccggaactgcaacccgcgcagatcctggcctggctgacaggagaacgcgacgacgccttaaccccggcgtacctcgataagcttaacgtccgcgaactggaagcgaccttcccgtctgaaacggcgatgatgtcgcccgcacgctggagccgcgttaacgcgtgccttcacggtacgctgcccgcacacctgcaggtaaaaagcaccactcgtcaggggcaattacgggtagccttttgttcacaggatggattgctgatcaatggtcattttggtcaggggcggctgttttttatctacgcctttgatgaacagggcggatggctacacgcgttacgccgtcttccctcggccccgcaaacccaggagccgaatgaagttcgcgcgcagctcctgagtgattgccacctgctgttttgtgaagccattggcggccctgcggcggcccggctgattcgtcacaatatccacccgatgaaagtgtcgccagggatgtccattgccgcccagtgtgatgccattaccgcactgctgagcggacgtctgccaccgtggctggcaaaacgtcttgagaaagccaacccgctggaagagcgggtgttttaa

SEQ ID NO: 127 - DNA, 1374 bp, Kluyvera intermedia
  gene (1)..(1374): nifD1
atgaagggaaatgacattctcgcgctgctggatgaacccgcctgcgaacacaatcacaaacagaaatccggctgtagcgcccctaaacccggtgccacggcgggcggttgcgcgttcgacggcgcgcaaatcaccctgttgccgctgtcggatgtggcgcacctggtccacggaccgattggctgcacgggaagctcctgggataaccggggcagtatgagctccggccccagtctcaaccggctcggctttaccaccgacctgaacgagcaggatgtcattatggggcgcggcgaacggcggcttttccacgcggtgcgtcatatcgtcaaccgttatcaccctgccgccgtgtttatctataacacctgcgttccggcgatggagggtgatgatattgacgccgtctgtcaggcggcggaaaccgccaccggcgtgccagtgattgccgttgatgccgccgggttctatggcagcaaaaaccttggcaaccgtctcgcgggtgaagtgatggttaacaaggtcattggacggcgcccgcccgccccctggccggacgatacccccttcgcgccggaacaccgccacgatatcggcctgattggcgaatttaatatcgccggggagttctggcacgttcagccgctgctcgatgagctgggtattcgcgtgctgggcagcctttccggggatggccgttttagtgaaatccagaccctgcaccacgcgcaggtcaatatgctggtctgctcaagagcgctgatcaatgttgcccgcaccctggaacagcgctatggcaccccctggtttgagggcagtttttacggcgtgcgcgctacctccgatgccctgcgtcaactggcatccctgcttggcgacagcgatctgattgcccgcaccgaagccgttattgcccgcgaagaagccacggcaaatcaggcgctcgccccgtggcgcgaacggctacagggtcgcaaagtgctgctctataccggtggggtgaaatcctggtcggtggtctccgcattgcaggatttagggatgaccgtcgtggcgactggcacccgcaaatctaccgaagaagataagcagcgtattcgcgaattaatgggcgatgacgcgctaatgctggaagaaggcaacgcccgcaccctgctggatgtggtgtaccgctatcaggcggatttgatgatcgctggggggcgtaacatgtataccgcgtacaaagcgcggctgccgtttctggatatcaaccaggagcgtgaacacgcctttgcgggttatcgcggcatcgtcaccctcgcccaacagctttgccagactattgaaagccccgtctggccgcaaacacacgcccgcgcgccgtggcaataa

SEQ ID NO: 128 - DNA, 1449 bp, Kluyvera intermedia
  gene (1)..(1449): nifD2
atgagcaatgcaacaggcgaacgtaatctggaaattatccaggaagtgctggagatctttcccgaaaaaacgcgcaaagaacgcagaaagcacatgatggtgaccgacccggagatggaaagcgtcgggaaatgcatcatctctaaccgcaaatcgcagccgggtgtgatgactgtccgcggctgctcctacgccgggtcgaaaggcgtggtttttgggccgattaaagatatggcccacatctcccacggcccgatcggctgtgggcagtactcccgtgccgggcggcgcaactactacaccggggtcagcggcgttgattccttcgggacgctgaactttacctctgattttcaggagcgcgatatcgtcttcggcggcgataaaaagctcaccaaactgattgaggagatggaggaactgttcccgctgaccaaaggcatctccattcagtcggagtgcccggtaggtttaatcggtgacgatatcgaagcggtggcgaatgccagtaaaaaagcgctcaacaagccggtgatcccggtgcgttgcgaaggctttcgcggcgtgtcgcagtcgctcggtcaccatatcgccaacgacgttatccgcgactgggtgctggataaccgcgaagggaagcccttcgaatctaccccctatgacgtggccatcatcggcgattacaacatcgggggggatgcctgggcgtcgcgcattctgcttgaagagatggggttacgcgtggtggcgcagtggtccggtgacggcacgctggtagagatggaaaacaccccgttcgtcaagctgaacctggtgcactgctaccgctctatgaactacatctctcgccatatggaagagaaacacggtatcccgtggatggagtacaacttcttcggcccgaccaaaatcgccgaatcgctgcgtaagatcgccgatcaatttgacgacaccatccgcgccaatgcggaagcggtgatcgccaaatatcaggcgcaaaacgatgcgattatcgccaaataccgcccgcgtctcgaaggccgcaaggtgctgctctatatgggtggcctgcgtcctcgccacgtgattggcgcgtatgaggatttgggcatggagattgtcgccgccgggtatgaatttgcccataacgacgattacgaccgcaccctgccggacctcaaagagggcacgctgttgttcgacgatgccagcagttatgaactggaagccttcgtgaaggcgattaagccggacctcattggctcaggcatcaaggaaaaatacattttccagaaaatgggggtaccgtttcgccagatgcactcctgggattactccggcccgtatcacggctatgacggctttgccatctttgcccgcgatatggacatgacgctcaacaatcccgcctggggcgagttgaccgcaccctggctgaaatcagcctga

SEQ ID NO: 129 - DNA, 1383 bp, Kluyvera intermedia
  gene (1)..(1383): nifK1
atggcagatatcatccgtaatcagaaaccgctggcggtaagcccggtaaaaagcggccagccgttaggcgccattctggcgagcctcggctttgagcacagtattccactggtgcacggtgcgcagggatgcagcgcgttcgccaaagtgttttttatccaacattttcatgaccctattccgctgcaatccacggcgatggaccccacctcaacggtcatgggggcggacggcaatatccttgccgcgctcaatacgctgtgccagcgcaacaccccgaaagctatcgtcctgttgagtaccggcctgtctgaggcgcagggcagcgatatcagccgcgtggtacgtcagtttcgtgaggattttccccgccacaaaaatatcgccctcctgacggtcaacaccccggatttttacggcacgctggagaacggctttagtgcggtggtggaaagcgtcatcgaacagtgggtgccggaaaagcctcagcatggcctgcgtaaccggcgggtcaacttgttgttaagtcacctgctgacgcccggtgatgttgagttgctgcgcagctacgtggaggcttttggcctgcaaccggtgatcgtgccggatctttcacagtcgctggatggtcacctggcaagcggtgatttttcgccggtcactcaggggggaacgcccctgcgcattatcgaacagatgggacagagcctgtgcacgtttgctattggcgtgtcgctgtcccgtgcggcatcgctgctggcacagcgtagccgtggcgaggtgatcgtgcttccccatctgatgaccatggaacattgcgaccgttttattcatcaactgaagatcatttccgggcgcgaggttcccgcctggattgagcgccagcgcggacaattgcaggatgcgatgatcgattgtcatatgtggttgcaggatacccggctcgcgctggccgccgagggcgatctgctggcgggctggtgtgatttcgcccgtagccagggcatgctccccggccccgttgtggcgccggtcagccagccgggcctgcaacagcttcccgtggagaaagtggtcattggcgatctggaagatatgcaggatttactctgcgctatgcctgctgacctgctggtcgccaactcccatgccgcagacctggccgaacaattctccatcccgctgatccgcgccgggttccctatcttcgacaggcttggcgaatttcgtcgcgtgcgtcagggataccccggcattcgcgacacgctgtttgagctggcgaacctgatgcgcgaacgtcatcaccacctgcccgtctaccgctcccccctgcgccagcaatttgcccaggacgctgacggaggccgctatgcaacatgttaa

SEQ ID NO: 130 - DNA, 1563 bp, Kluyvera intermedia
  gene (1)..(1563): nifK2
atgagccaaactgctgagaaaattgtcacctgtcatccgctgtttgaacaggacgaataccagacgctgtttcgcaataagcgcggtctggaagaggcgcacgacccgcagcgcgtgcaagaggtttttgaatggaccaccacggcggagtatgaagcgctgaactttaagcgtgaagcgttaaccgtcgatccggcaaaggcctgccagcctttaggatcggtactctgctcgctgggttttgccaatacgctgccttatgtgcacggttcccagggctgtgtggcctatttccgcacctattttaaccgtcatttcaaagagccgatcgcttgcgtttccgactctatgacagaggatgcggcggtcttcggcggcaacaacaaccttaacaccgggttgcaaaatgccagcgccctgtacaaaccggaaattgtcgctgtctccactacctgtatggcggaggtcatcggcgatgacctgcaggcctttatcgccaacgccaaaaaggacgggtttattgatgccgccattccggtgccctacgcccatacgccaagttttatcggtagccacatcaccggctgggacaacatgtttgaaggtttcgcccgggcatttaccgccgatcacgtggcgcaaccgggcaaactggcgaagctaaacctggtgaccggttttgaaacctatcttggcaattaccgcgtgctcaaacgcatgatggcccagatggaggtgccctgtagcctgctgtctgacccgtctgaggtgttagatacgccagccgacggccactatcgcatgtatgcgggcggcacaacgcaacaagagatgcgcgacgcccccgatgctatcgacaccctgctgctgcaaccctggcatctggtgaagagtaaaaaagtggtgcaggagtcctggggccagcccgccacagaagtgtccatcccaatgggactgaccgggaccgacgaactgctgatggcagtcagtcagttaaccggcaaaccggtggccgatgaactgacgctggagcgtgggcgcctggtggatatgattctcgattcacacacctggctgcacggtaagaaattcggtctctacggcgatccggattttgtgatggggctgacgcgtttcctgctggaactgggctgcgagccgacggttatcctctgtcataacggtagcaagcgctggcagaaagcgatgaagaaaatgcttgaggcatcgccctacggtcaggagagcgaagtgttcatcaactgcgatctgtggcatttccgctcgctgatgtttacccgcaaaccggactttatgatcggcaactcgtacgccaaattcatccagcgtgacacgctggcgaaaggcgaacagtttgaagttccgctgatccgtcttggcttcccgttgttcgaccgccaccacctgcatcgccagaccacatggggttatgaaggggcgatgaatatcgtcaccaccctggtcaacgccgtgctggaaaaagtcgaccgcgataccatcaaactgggcaaaacggactacagcttcgaccttgtccgctaa

SEQ ID NO: 131 - DNA, 1488 bp, Kluyvera intermedia
  gene (1)..(1488): nifL
atgacctttaatatgatgctggagaccagcgcaccgcagcacattgcgggcaacctctcacttcaacatcccggactgttttccacgatggttgaacaggctccgatcgcgatttcgctgaccgacccggacgcgaggattctgtacgctaatccggccttttgtcgccagaccggttatagcctggaagagctgctcaaccagaaccatcgcatactggcaagccaacagacgccgcgcagcatttatcaggaactgtggcaaacgctgctgcaacagatgccctggcgcggtcagctcatcaatcgccgtcgggatggcagcctttatctggctgaggtcgatatcaccccggtcgtcaacaaacagggcgaactggaacactacctcgccatgcaacgtgatatcagcgccagctatgcgctcgaacagcgattgcgcaatcacaccaccatgagcgaggcggtgctgaacaacattcctgccgccgtggtggtggtcaacgagcaggaccaggtagtcatggacaacctcgcctacaaaaccttctgtgccgactgcggtggcaaggagctgctcaccgaactggatttctcccggcgcaaaagcgatctctatgccgggcaaatactgcctgtggtgctgcgcggcgccgtgcgctggctctctgtcacctgctggaccttgccgggggtgagcgaagaagccagccgctactttattgataccgcgctgccccgcaccctggtggtgatcaccgactgcacccagcaacaacaacaggccgaacagggccgtctcgatcgtctcaaacaggagatgaccaccgggaagctgctggccgcgatccgtgaatcgttggatgccgcgctggttcagctaaactgccccatcaatatgctggcggcggcgcgacgtctcaacggtgaagataaccataacgtggcgctggatgccgcgtggcgcgagggggaagaggcgctggcccgcctgcaacgctgccgcccttctctcgatctggaagagagcgcgctgtggcctctgcaaccgctgtttgacgacctgcgcgccctttaccatacccgctataacaatggcgaaaatctgcacgttgaaatggcctctccgcatctggcggggtttggtcagcgcacgcagatccttgcctgtctcagtttgtggctcgaccgtacgctggccctcgccgccgcgctaccggacagaacgctgcatacccagctttacgcccgtgaagaagatggctggctgtccatttggctgacagataatgtgccgctcatccatgtgcgatacgcccactcccccgatgccctgaacgcccccggcaaagggatggagctgcgattgattcaaaccctggttgcccatcatcgcggcgcaatagaactaactacccgccctgaaggcggtacctgcctgaccctgcgattcccgttatttcattcactgaccggaggcccacgatga

SEQ ID NO: 132 - DNA, 1572 bp, Kluyvera intermedia
  gene (1)..(1572): nifA
atgacccagcgacccgagtcgggcaccaccgtctggcgttttgatctctcacagcaatttaccgccatgcagcgcatcagcgtggtgttgagtcgcgcaaccgagataagccagacgctgcaggaggtgctgtgtgttctgcataatgacgcatttatgcaacacggcatgctgtgtctgtatgacaaccagcaggaaattctgagtattgaagccttgcaggaggcagaccaacatctgatccccggcagctcgcaaattcgctatcgccctggcgaagggctggtaggagccgtactgtcccagggacaatctcttgtgctgccgcgtgtcgccgacgatcaacgctttctcgacaggcttggcatctatgattacaacctgccgtttatcgccgtccccttaatggggccaggcgcgcagacgattggcgtgctcgccgcgcagccgatggcgcgtctggaggagcggcttccttcctgtacgcgctttctggaaaccgtcgccaatctggtcgcacagacagtccggctgatgaccccgcctgccgccgccacaccgcgcgccgcgattgcccagaccgaacgccagcgcaactgtggcactcctcgccccttcggctttgagaatatggtgggcaaaagcccggccatgcagcagacaatggacattatccgccaggtttcgcgctgggataccacggtactggtgcgcggcgaaagcggcaccggtaaagaacttatcgccaatgctattcatcacaactcccctcgcgccgccgcgccctttgtgaaatttaactgcgcggcgctaccggatacgctactggagagcgaattgttcggccatgaaaaaggggcgttcaccggcgcggttcgccagcgtaaaggacgttttgaactggccgatggcggcacactgtttcttgatgaaattggcgaaagcagcgcctcgttccaggccaaactgctgcgtattttgcaggagggtgaaatggagcgcgttggcggcgacgaaaccctgcgcgtcaatgtgcgtatcatcgccgccaccaaccggaatctggaagaagaggtgcggatgggcaatttccgcgaggatctctattatcgcctcaacgtaatgcccatctccctgcccccgctgcgtgaacgtcaggaggacattgccgagctggcgcactttctggtgcgcaaaatcgcccataaccaggggcgtacgctgcgcatcagtgatggcgccatccgtctgctgatgggttacaactggcccggtaacgtgcgtgagctggaaaattgcctggaacgttcggcagtgatgtcagaaaacggcctgatcgaccgcgatgtggtgctctttaaccaccgtgagaacacgccaaaactcgctatcgccgccgcgccaaaagaggatagctggcttgatcaaacgctggatgaacgtcaacggctgattgccgcgctggaaaaagccgggtgggtgcaggccaaagcggcgcgtctgctgggtatgacgccccgtcaggtcgcctatcggatacaaattatggatatcagcatgcccaggatgtga

SEQ ID NO: 133 - DNA, 2853 bp, Kluyvera intermedia
  gene (1)..(2853): glnE
atgatgccgcactctccacagctacagcagcactggcaaactgtactggcccgcttgcctgagtcattcagtgaaacaccgcttagtgaacaagcgcagttagtgcttactttcagtgattttgtgcaggatagccttgccgcgcatcctgactggctggctgagctggaaagcgcaccgccacaggcggacgagtggaagcagtatgcgcaaacccttcgcgaatcgctggaaggtgtgggagatgaggcatcattaatgcgtgcgctgcgcctgttccgtcgccatatgatggtgcgcattgcctgggcgcagtcgctggcgctggtggcagaagatgagacgttgcagcagttgagcgtactggcggagaccctgatcgtcgctgcacgcgactggctttacgatgcctgctgtcgcgagtggggaacgccgtgcaatcagcagggggaaccgcagccgttgctgatcctgggcatgggcaagctgggtggcggggagcttaacttttcgtccgatatcgatctgatttttgcctggccggaaaacggttcaacgcgcggtgggcgacgcgaacttgataacgcccagttttttactcgcttgggacagcgcctgatcaaagtgctcgaccagccgacgcaggatggctttgtctatcgcgtggatatgcggctgcgcccgtttggcgacagcggtccgctggtgctgagttttgccgcgctggaagattattatcaggagcaggggcgcgactgggaacgttatgcgatggtgaaagcccgcattatgggcgataaggacgatgtttacgctggcgaattacgggccatgctgcggccgttcgtcttccgtcgctatatcgatttcagcgttattcagtctctgcgtaacatgaaagggatgattgcccgcgaagtgcgccgccgtggtctgaaagataacattaagctgggcgcgggcggcatccgtgagattgagtttatcgttcaggtgttccagttgatacgcggtgggcgcgagccgtcgttgcagtcccgttcactgttaccgacgctggacgctatcgataagctgggtttgctgccgcctggcgatgcaccggcgttacgccaggcctatttgtatctgcgccgtctggaaaacctgctgcaaagcattaacgacgaacaaacgcagacgctgccgacagatgaactcaatcgcgcgcgtctggcctgggggatgcgggtcgcagactgggaaaccctgaccgctgagcttgaaaagcagatgtctgccgtacgagggatattcaacaccctgattggcgatgacgaagccgaagagcagggggatgcgctctgcgggcaatggagtgagttgtggcaggatgcgtttcaggaagatgacagcacgcctgtgctggcgcacctttctgacgatgatcgccgccgcgtggtcgcgatgattgctgattttcgcaaagagctggataaacgcaccattggcccacgcggccgccaggtgctcgaccatctgatgccgcatctgttgagtgatgtctgctcccgtgaggatgcccctgtaccgttgtctcgcgtgacgccgctgttaacgggaattgtcacgcgtacgacgtatcttgagctgctcagcgagtttcctggtgcgcgtaagcatctgatttcactctgtgccgcctcgccgatggtggccagtaagctggcgcgctatccgttattgctggatgagttgctcgatccgaataccctttatcagcccacggcgatgaatgcctaccgggatgagctacgtcagtatctgctgcgtgtgccggatgacgatgaagagcagcaactggaggcgttacgccagtttaaacaggctcaattgttgcgtgtggcggcagcagatctggcaggcacactccccgtgatgaaagtgagcgatcacttaacatggcttgccgaagccatcattgaagccgtggtacaacaggcgtggagcctgatggtatcgcgttatgggcagccgaaacacttacgcgaccgtgaaggccgtgggtttgcagtggtcggttacggcaaactgggcggttgggagctgggctatagttccgatctggatttgattttccttcatgactgtccggtggacgtgatgactgacggcgagcgggaaatcgatggccgccaattttatctgcgccttgcccagcgcgtgatgcacctgttcagtacgcgcacctcatccgggatcctgtatgaggtagacgcgcgcttgcgcccgtccggtgcggcgggaatgctggtgacctcaaccgaatcctttgccgactaccagcgcaccgaagcctggacctgggaacatcaggcgctggttcgcgcccgcgttgtctatggcgatccacaattaaacgcgcaatttgatgccatccgccgcgatatcaccatgaccgtgcgtaatggtgcaacgttacaaaccgaggtgcgcgagatgcgcgaaaaaatgcgcgcccacttgagcaataagcacaaggatcgctttgatattaaagccgatgagggtggaattaccgatatcgaatttatcacccagtatctggtgctgcgttatgcccatgccaaaccgaaactgacgcgctggtcggacaatgtccgcattctggaagggctggcgcaaaacggcattatggaagagcaggaagcgcaggcacttaccaccgcctatacaacgttgcgtgatgagctgcatcacctggcgctacaggagctgccaggacatgttccggaggcatgttttgtcgctgaacgcgcgatggtgcgagcctgctggaacaagtggttggtggagccgtgcgaggacgcgtaa

SEQ ID NO: 134 - DNA, 1290 bp, Kluyvera intermedia
  gene (1)..(1290): amtB
atgaagaaagcactattaaaagcgggtctggcctcgctggcattactgccgtgtctggctatggcagccgatccggttgtcgtcgataaagccgacaatgcctttatgatgatttgcaccgcgctggtgctgtttatgtcaattccgggcatcgccctgttctatggtggtttaatccgcggtaaaaacgtcctttctatgctgacacaggttgcggttacgttcgcactggtgtgcgtgctgtgggtggtttacggctactctctggcctttggcactggcggcagcttcttcggtagcttcgactgggtgatgctgaaaaatattgagctgaaagcgctgatgggcaccatctatcagtacattcacgttgcgttccagggctcgtttgcctgtattaccgtcggcctgattgtcggtgcgctggcagaacgtatccgtttctccgcagtactgattttcgtcgtggtatggctgacgctgtcctacgtgccgatcgcacacatggtctggggcggcggtctgctggcaacccatggcgccatggattttgcgggcggtacagtcgttcacatcaacgcagccgttgcaggcctggtgggtgcttacctgattggcaaacgtgtcggtttcggtaaagaagcgtttaaaccgcacaacctgccgatggtgtttaccggtacggcaatcctctactttggctggttcggattcaacgcgggttctgcaagcgcggcgaacgaaattgcgggtctggcttttgttaacaccgtcgtggcaacagcgggtgcaatcctctcctgggtcttcggtgagtgggcgctgcgcggcaaaccgtctctgttgggtgcctgttctggtgcgattgctggcctcgtgggtatcaccccggcgtgtggttacgttggtgtgggtggcgcgctgatcgtgggcatcgttgcaggcctggcgggtctgtggggcgttaccgcgctgaaacgctggctgcgtgttgacgacccgtgtgatgtcttcggtgttcacggcgtgtgcggtatcgtaggttgtatcatgacaggtatcttcgcagccacttcactgggcggcgtgggttatgccgaaggcgtgaccatgggccatcaggttctggtacaactggaaagtatcgccattactatcgtatggtctggtatcgtcgcctttatcggttacaaactggctgatatgacagtgggtctgcgtgttccggaagatcaggaacgcgaagggctggacgtcaacagccacggcgagaacgcctacaacgcctga

SEQ ID NO: 135 - DNA, 498 bp, Kluyvera intermedia
  gene (1)..(498): PinfC
ctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtatt

SEQ ID NO: 136 - DNA, 1537 bp, Kosakonia pseudosacchari
  gene (1)..(1537): 16S
  misc_feature (454)..(454): n is a, c, t, g, unknown or other
attgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcganacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggcttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 137 - DNA, 882 bp, Kosakonia pseudosacchari
  gene (1)..(882): nifH
atgaccatgcgtcaatgcgccatttacggcaaaggtgggatcggtaaatcgaccaccacacagaacctggtcgccgcgctggcggagatgggtaagaaagtcatgatcgtcggctgcgatccgaaagccgactccacgcgtttgatcctgcatgcgaaagcgcagaacaccattatggagatggccgccgaagtcggctccgtcgaagacctggaattagaagacgtgctgcaaatcggttacggcggcgtgcgctgcgcggaatccggtggcccggagccaggtgtgggttgtgccggtcgtggcgtgatcaccgcgattaacttcctcgaagaagaaggcgcttacgtgccggatctggattttgttttctacgacgtgctgggcgacgtggtatgcggtggtttcgccatgccgattcgtgaaaacaaagcgcaggagatctacatcgtttgctctggcgaaatgatggcgatgtacgccgccaataacatctccaaaggcatcgtgaaatatgccaaatccggtaaagtgcgcctcggcgggctgatttgtaactcgcgccagaccgaccgcgaagatgaactcatcattgcgctggcggaaaaactcggcacgcaaatgatccactttgttccccgcgacaacattgtgcagcgtgcggaaatccgccgtatgacggttatcgaatatgacccgacctgcaatcaggccaacgaatatcgcagccttgccagcaaaatcgtcaacaacaccaaaatggtggtaccaaccccctgcaccatggatgaactggaagaactgctgatggagttcggcattatggatgtggaagacgccagcatcattggtaaaaccgccgccgaagaaaacgccgtctga

SEQ ID NO: 138 - DNA, 1449 bp, Kosakonia pseudosacchari
  gene (1)..(1449): nifD1
atgagcaatgcaacaggcgaacgtaacctggaaatcatcgagcaggtgctggaggttttcccggaaaagacgcgcaaagagcgcagaaaacacatgatggtgacggacccggagcaggagagcgtcggcaagtgcatcatctctaaccgcaaatcgcagccgggcgtgatgaccgtgcgtggctgctcgtatgccggatcaaaaggggtggtatttgggccaatcaaagatatggcgcatatctcccacggcccgatcggctgcgggcagtactcccgcgccgggcggcgtaactactataccggcgtcagcggcgtggacagtttcggcacgctcaacttcacctccgatttccaggagcgcgacatcgtgtttggcggcgacaaaaagctcgccaaactgattgaagagctggaagaactgtttccgctgaccaaaggcatttcgattcagtcggaatgcccggtcggcctgattggcgatgatattgaagccgtggcgaacgccagccgcaaagcgatcaacaaaccggttattccggtgcgttgcgaaggctttcgcggcgtgtcgcaatccctcggtcaccatattgccaacgatgtgatccgcgactgggtactggataaccgcgaaggcaaaccgtttgaatccaccccttacgatgtggcgatcatcggcgattacaacatcggtggcgacgcctgggcctcgcgcattttgctcgaagagatggggttgcgggtggtcgcgcagtggtccggcgacggtacgctggtggagatggaaaacacgccgttcgtcaaactgaacctggtgcactgctaccgctcgatgaactacatctcgcgccatatggaggagaagcacggtattccgtggatggaatacaacttctttggcccgacgaaaatcgcggaatcgctgcgcaaaatcgccgacctgttcgacgacaccattcgcgccaacgccgaagcggtgatcgcccgataccaggcgcagaacgacgccattatcgccaaatatcgcccacgtctggagggtcgcaaagtgttgctctatatgggcgggctgcgtccgcgccatgtgattggcgcctatgaagatctgggaatggagatcatcgccgccggttatgagtttggtcataacgacgattacgaccgcaccctgccggatctgaaagagggcacgctgctgtttgatgacgccagcagctatgagctggaggcgtttgtcaacgcgctgaaaccggatctcatcggttccggcatcaaagagaagtacatctttcagaaaatgggcgtgccgtttcgccagatgcactcctgggattactccggcccgtaccacggctatgacggcttcgccatcttcgcccgcgatatggatatgacgctcaacaaccccgcctggggtcagttgaccgcgccgtggcttaaatccgcctga

SEQ ID NO: 139 - DNA, 1374 bp, Kosakonia pseudosacchari
  gene (1)..(1374): nifD2
atgaaggggaacgacatcctggctctgctcgatgaaccagcctgcgagcataaccataaacagaaaaccggctgtagcgcgccaaaacccggcgccaccgccggaggctgcgccttcgacggcgcacagatcaccctgctgccactttccgatgtggcgcatctggtacatggcccgattggctgcgccggcagctcatgggataaccgtggcagcctgagttctggcccgctgattaaccgactcggattcaccactgatttgaacgaacaggatgtcatcatggggcgcggcgagcggcggttgtttcacgcggtgcgccatattgtcgagcgctatcacccggcggcggtatttatttacaacacctgcgttccggctatggaaggcgatgacattgacgcggtctgccaggccgccgcgaccgccaccggtgtgcccgtgattgccgtagatgtggccggtttttacggtagcaaaaacctgggtaaccgcctcgcgggcgaggtgatggtgaaaaaagttatcggcgggcgcgaacccgcgccgtggccggacaatacaccttttgccccggcgcaccgccatgacataggcctgattggcgaatttaacatcgccggcgagttctggcatatccagccgctgcttgatgagctgggtattcgcgtccttggctccctttccggcgacgggcgctttgccgagatccagacgttgcaccgcgcgcaggtcaatatgctggtgtgctccagggcgctgattaatgtcgccagatcgcttgaacaacgttatggcacaccctggtttgaaggcagtttttatggcgttcgcgccacctccgatgccctgcgccagctggcaacactcaccggcgatagcgatttaatggcgcgaaccgaacggctgatcgcacgtgaagagcaagccacagaacaggcgctagcaccgctgcgtgaacggttacacggccggaaagtgctgctctataccggtggcgtgaaatcctggtcggtggtttcggcgctgcaggatctcggcatgacggtcgttgctaccggaacgcgcaaatccaccgaagaggataaacaacgcatccgtgaactgatgggcgatgacgccatcatgctggatgaaggcaatgcccgcgccttgctggatgtggtctatcgctacaaagccgacatgatgatcgcgggcgggcgcaacatgtacaccgcctataaagcgcgtctgccctttctggatatcaaccaggagcgtgaacacgcgtttgccggttatcgcggcatcatcacgcttgccgaacaactttgtcagacgctggaaagcccggtctggccgcaaacacatgcccgcgccccgtggcaataa

SEQ ID NO: 140 - DNA, 1563 bp, Kosakonia pseudosacchari
  gene (1)..(1563): nifK1
atgagccagactgctgagaaaatacagaattgccatcccctgtttgaacaggacgcctaccagacactatttgccggtaaacgggcactcgaagaggctcactcgccggagcgggtgcaggaagtgtttcaatggaccaccaccccggaatacgaagcgctgaacttcaaacgcgaagcgctgactatcgacccggcaaaagcctgccagccgctgggggcggtgctctgttcgctggggtttgccaacaccctgccgtatgtgcacggttcacagggttgtgtggcctatttccgtacgtactttaaccgccacttcaaagaaccggtggcctgcgtgtcggattcgatgacggaagacgcggccgtgttcggcgggaataacaacctcaacaccgggttacaaaacgccagcgcactgtataaaccggagattatcgccgtctctaccacctgtatggcggaagtgatcggtgatgatttacaggcgtttatcgccaacgccaaaaaagatggttttctcgatgccgccatccccgtgccctacgcccacacccccagttttatcggtagccatatcaccggctgggacaacatgtttgaaggttttgcccgtacctttaccgcaaaccatcagccacagcccggtaaactttcacgcctgaacctggtgaccgggtttgaaacctatctcggcaatttccgcgtgctgaaacgcatgatggaacaaatggaggtgcaggcgagtgtgctctccgatccgtcggaggtgctggacacccccgccaatggccattaccagatgtacgcgggcggtacgacgcagcaagagatgcgcgaggcaccggatgccatcgacaccctgctgctgcaaccgtggcagctggtgaaaagcaaaaaagtggtgcaggagatgtggaatcagcccgccaccgaggttgccattcccgtcgggctggcaggcacagacgaactgttgatggcgattagccagttaaccggcaaagccattcccgattcgctggcgctggagcgcgggcggctggtcgatatgatgctcgactcccacacctggttacacggtaaaaaattcggtctgtttggcgatccggattttgtcatgggattgacccgcttcctgctggaactgggctgtgaacctgccgtcatcctctgccataacggtaacaaacgctggcaaaaagcgatgaagaaaatgctcgatgcttcaccgtacggccaggagagcgaagtgtttatcaactgcgacttgtggcatttccgctcgctgatgttcacccgccagccggattttatgattggcaactcgtacgccaagtttattcagcgcgacaccttagccaagggcgaacagtttgaagtcccgctgatccgcctcggttttccgctgttcgaccgtcaccatctgcaccgccagaccacctggggctacgagggcgcgatgagcattctcacgacgctggtgaatgcggtactggagaaagtggacaaagagaccatcaagctcggcaaaaccgactacagcttcgatcttatccgttaa

SEQ ID NO: 141 - DNA, 1386 bp, Kosakonia pseudosacchari
  gene (1)..(1386): nifK2
atggctgatattgttcgtagtaaaaaaccgctggcggtgagcccgataaaaagcggccagccgctgggggcgatcctggcaagcctgggtttcgaacagtgcataccgctggtacacggcgctcaggggtgcagcgcgttcgcgaaagtgttctttattcaacattttcacgacccgatcccgctgcaatcgacggcgatggacccgacttccaccattatgggcgccgatgaaaacatttttaccgcgctcaatgttctctgccagcgcaacgccgcgaaagccatcgtgctgctcagcaccgggctgtcagaagcccagggcagcgatatttcacgagtggtgcgccagtttcgtgatgactttccgcggcataaaaacgtggcgctgctcaccgtcaacaccccggatttctacggctcgctggaaaacggctacagcgccgtgctggaaagcatgattgaacagtgggtgcccgcgcagcccgccgccagcctgcgcaaccgtcgcgtcaacctgctggtcagccatttactgacgccgggcgatatcgaactgttacgcagttatgtggaagcattcggtctgcaaccggtgattgtgccggatctatcgcagtcgctggacggacatctggccaacggtgatttttcgcccgtcacccaggggggaacaccgctgcgcatgattgaacagatggggcaaaacctggccacttttgtgattggccactcgctggggcgggcggcggcgttactggcgcagcgcagccgtggcgaggtgatcgccctgccgcatctgatgacgcttgatgcgtgcgacacctttatccatcgcctgaaaaccctctccgggcgcgacgtgcccgcgtggattgagcgccagcgcgggcaagtgcaggatgcgatgatcgattgccatatgtggttgcagggcgcggctatcgccatggccgcagaaggcgatcacctggcggcatggtgcgatttcgcccgcagccagggcatgatccccggcccggttgtcgcgccggtcagccagccggggttgcaaaatctgccggttgaaatggtggtcatcggcgatctggaagatatgcaggatcggctttgcgcgacgcccgccgcgttactggtggccaattctcatgccgccgatctcgccacgcagtttgatatgtcgcttatccgcgccgggtttccggtgtatgaccggctgggggaatttcgtcggctgcgccaggggtatagcggcattcgtgacacgctgtttgagctggcgaatgtgatgcgcgaacgccattgcccgcttgcaacctaccgctcgccgctgcgtcagcgcttcggcgacaacgttacgccaggagatcggtatgccgcatgttaa

SEQ ID NO: 142 - DNA, 1488 bp, Kosakonia pseudosacchari
  gene (1)..(1488): nifL
atgaccctgaatatgatgatggatgccagcgcgcccgaggccatcgccggtgcgctttcgcaacaacatcctgggctgttttttaccatcgttgaagaagcccccgtcgctatttcactaaccgatgccgaggcacgtattgtctatgccaacccggcattctgccgccagaccggctatgagcttgaggagttgttgcagcaaaatccccgcctgcttgccagtcagcagaccccacgggaaatctaccaggatatgtggcacaccctgttacaacgtcgaccatggcgcgggcaattgatcaaccgccaccgtgacggcagcctttttctggttgagatcgatatcaccccggtgattaacccgtttggcgaactggaacactacctggccatgcagcgcgatatcagcgccggttatgcgctggagcagcggttgcgtaatcacatggcgctgaccgaagcggtgctgaataacattccggcggcggtggtcgtggtcgatgaacgcgatcgtgtggttatggataacctcgcctataaaactttctgtgctgattgcggcggaaaagagctactgagcgaactccatttttcagcccgtaaagcggagctggcaaacggccaggtcttaccggtggtgctgcgcggcgcggtgcgctggttgtcggtcacctgctgggcgctgccaggcgtcagcgaagaagccagtcgctactttattgataataccttgacgcgcacgctggtggtcatcaccgacgacacccagcagcgccagcagcaagagcaaggacggcttgaccgccttaaacagcagatgaccagcggcaaactgctggcggcgatccgcgaagcgcttgacgccgcgctgatccagcttaactgccccatcaatatgctggcggcggcgcggcgtttaaacggcagtgataacagcaacgtagcgctggacgccgcgtggcgcgaaggtgaagaagcgatggcgcggctgaaacggtgccgcccgtcgctggagctggaaagtgccgccgtctggccgctgcaacccttttttgacgacttgcgcgcgctttatcacacccgctacgagcagggtaaaaatttgcaggtcacgctggattcgacgcatctggtgggatttggtcagcgaacccaactgctggcctgcctgagtctgtggctcgatcgcacgctggatattgccgtcgggctgcgtgatttcaccgcccaaacgcagatttacgcccgggaagaagcgggctggctctcgttgtatatcactgacaatgtgccgttgattccgctgcgccatacccattcgccggatgcgcttaacgcaccgggaaaaggtatggagttgcggctgatccagacgctggtagcgcatcacaacggcgcgatagaactcacttcacgccccgaagggggaagctgcctgaccctacgattcccgctatttcattcactgaccggaggttcaaaatga

SEQ ID NO: 143 - DNA, 1575 bp, Kosakonia pseudosacchari
  gene (1)..(1575): nifA
atgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtcgcgaatctggtggcgcagaccgtgcgtttgatgacgccgccggctgcacgcccttccccacgcgctgccatcacgccaaccgccagcccgaaatcgtgcagtacttcacgcgcgttcggcttcgaaaatatggtcggcaacagcccggcaatgcgccagaccatggagattatccgtcaggtttcgcgctgggataccaccgttctggtgcgcggcgagagcggcaccggcaaggaactgattgccaacgccatccatcacaattcgccgcgcgccagtgcgccatttgtgaaattcaactgtgcggcgctgccggacacattgcttgaaagcgaattatttggtcatgaaaaaggcgcctttaccggcgcggtacgccagcgtaaaggccgttttgagctggccgatggcggcacgctgtttcttgacgaaattggggaaagcagcgcctcgtttcaggctaagctgctgcgtattttgcaggagggcgaaatggaacgcgtcggtggtgacgagacattgcaagtgaatgtgcgcatcattgccgcgacgaaccgcaaccttgaagatgaagtacgcctgggacattttcgcgaagatctctattaccgcctgaatgtgatgcccatcgccctgccgccgctgcgcgaacgccaggacgacatcgccgaactggcacattttctggtgcgtaaaatcgcccacaaccagaaccgcacgctgcgcattagcgagggcgctatccgcctgctgatgagctacagctggcccggcaatgtgcgcgaactggaaaactgccttgagcgctctgcggtgatgtcggaaaacggtctgatcgatcgggacgtgattttatttaatcatcgcgaccagccagccaaaccgccggttatcagcgtcacgcccgacgataactggctcgataacacccttgacgagcgccagcggctgattgccgcgctggaaaaagcgggatgggtacaagccaaagccgcccgcttgctggggatgacgccgcgccaggtcgcttatcgtattcagaccatggatatcaccctgccaaggctataa

SEQ ID NO: 144 - DNA, 2850 bp, Kosakonia pseudosacchari
  gene (1)..(2850): glnE
atgccgcaccacgcaggattgtcgcagcactggcaaacggttttttctcgtctgccggaagcgctcaccgcgcaaccattgagcgcgcaggcgcagtcagtgctcacttttagtgattttgttcaggacagcatcatcgtgcatcctgagtggctggcagagcttgaaagcgcaccgccgccagcgaacgagtggcaacactacgcgcaatggctgcaagcggcgctggagggcgtcaccgatgaaacctcgctgatgcgcacgctgcggctgtttcgccgtcgcattatggtgcgcatcgcctggagtcaggcgctacagttggtggcggaagaggatatcctgcaacagctcagcgtgctggcggaaactctgatcgtcgccgcgcgcgactggctctatgacgcctgctgccgtgagtggggaacgccgtgcaatccgcaaggcgtcgcgcagccgatgctggtgctcggcatgggcaaacttggcggcggcgaactcaatttctcatccgatatcgatttgatttttgcctggccggaaaatggcaccacgcgcggcggacgccgtgaactggataacgcgcagttttttacccgccttggtcaacggctaattaaagtcctcgaccagcccacgcaggatggctttgtctaccgcgtcgatatgcgcttgcgtccctttggcgacagcggcccgctggtgctgagttttgccgcgctggaagattactaccaggagcaggggcgcgactgggaacgatacgcgatggtgaaagcgcgcattatgggggacaacgacggcgaccatgcgcgagagttgcgcgccatgctgcgcccgttcgttttccgccgctatatcgacttcagcgtgatccagtctctgcgcaacatgaaaggcatgattgcccgcgaagtgcggcgtcgcggcctgaaggacaacataaaactcggcgcgggcggtattcgcgaaatagagtttatcgtgcaggttttccagttgattcgcggcggtcgcgagcctgcgctgcaatcgcgttcgctgttgccgacgcttgctgccattgatcaactacatctgctgccggatggtgatgcaccccggctgcgcgaggcgtatttgtggctgcgacggctggaaaacttgctgcaaagcattaatgacgaacagacacagacgctgccggccgatgatttgaatcgcgcgcgcctcgcctggggaatgggcaaagagagctgggaagcgctctgcgaaacgctggaagcgcatatgtcggcggtgcggcagattttcaacgatctgattggcgatgatgaaacggattcgccggaagatgcgctttctgagggctggcgcgaattgtggcaggatgcgttgcaggaagaggactctacgcccgtgctggcgcatctttccgaggacgatcgccgccgcgtggtggcgctgattgctgattttcgcaaagagctggataaacgcaccattggcccgcgcgggcgacaggtactcgatcacttaatgccgcatctgctcagcgatgtatgctcgcgtgacgatgcgccagtgccgctgtcgcgtctgacgccgctgctcaccggtattattacgcgcaccacttaccttgagctgctgagtgaattccccggtgcgctgaaacacctcatttccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaa

SEQ ID NO: 145 - DNA, 1287 bp, Kosakonia pseudosacchari
  gene (1)..(1287): amtB
atgaaaaacacaacattaaaaacggctcttgcttcgctggcgttgctgccaggcctggcgatggcggctcccgctgtggcggataaagccgacaacggctttatgatgatttgcaccgcgctggtgctgtttatgaccattccgggcattgcgctgttctacggcggtttgatccgcggtaaaaacgtgctgtcgatgctgacgcaggttgccgtcaccttcgctctggtgtgcatcctgtgggtggtttacggctactctctggcatttggcgagggcaacagcttcttcggcagtttcaactgggcgatgttgaaaaacatcgaattgaaagccgtgatgggcagcatttatcagtacatccacgtggcgttccagggctcctttgcttgtatcaccgttggcctgattgtcggtgcgctggctgagcgtattcgcttctctgcggtgctgatttttgtggtggtatggctgacgctttcttatgtgccgattgcgcacatggtctggggtggcggtctgctggcaacccacggcgcgctggatttcgcgggcggtacggttgttcacatcaacgccgcgatcgcaggtctggtgggggcttacctgattggcaaacgcgtgggctttggcaaagaagcgttcaaaccgcataacctgccgatggtcttcaccggcaccgcgatcctctatgttggctggtttggcttcaacgccggctctgcaagctcggcgaacgaaatcgctgcgctggctttcgtgaacacggttgttgccactgcggccgctattctggcgtgggtatttggcgagtgggcaatgcgcggtaagccgtctctgctcggtgcctgttctggtgccatcgcgggtctggttggtatcaccccggcgtgcggttatgtgggtgtcggcggcgcgctgattgtgggtctgattgccggtctggcagggctgtggggcgttactgcactgaaacgtatgttgcgtgttgatgacccatgcgatgtcttcggtgtgcacggcgtgtgcggcatcgtgggttgtatcctgaccggtatcttcgcgtctacgtcgctgggcggtgtcggtttcgctgaaggggtgaccatgggccatcaggtactggtacagctggaaagcgttgccatcactatcgtgtggtctggcgtggtggcctttatcggttacaaactggcggatatgacggtaggcctgcgcgtaccggaagagcaagagcgtgaagggctggatgtgaacagccacggcgaaaatgcgtataacgcctga

SEQ ID NO: 146 - DNA, 500 bp, Kosakonia pseudosacchari
  gene (1)..(500): PinfC
ttcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtatt

SEQ ID NO: 147 - DNA, 348 bp, Kosakonia pseudosacchari
  gene (1)..(348): Prm1
cgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgc

SEQ ID NO: 148 - DNA, 339 bp, Kosakonia pseudosacchari
  gene (1)..(339): Prm7
cgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgat

SEQ ID NO: 149 - DNA, 1538 bp, Unknown
  Enterobacter sp.
  gene (1)..(1538): 16S
  misc_feature (62)..(62): n is a, c, t, g, unknown or other
  misc_feature (265)..(265): n is a, c, t, g, unknown or other
  misc_feature (457)..(457): n is a, c, t, g, unknown or other
  misc_feature (469)..(469): n is a, c, t, g, unknown or other
  misc_feature (539)..(539): n is a, c, t, g, unknown or other
  misc_feature (551)..(552): n is a, c, t, g, unknown or other
  misc_feature (559)..(559): n is a, c, t, g, unknown or other
  misc_feature (561)..(561): n is a, c, t, g, unknown or other
  misc_feature (576)..(576): n is a, c, t, g, unknown or other
  misc_feature (587)..(587): n is a, c, t, g, unknown or other
  misc_feature (591)..(591): n is a, c, t, g, unknown or other
  misc_feature (655)..(657): n is a, c, t, g, unknown or other
  misc_feature (665)..(665): n is a, c, t, g, unknown or other
  misc_feature (678)..(678): n is a, c, t, g, unknown or other
  misc_feature (706)..(706): n is a, c, t, g, unknown or other
  misc_feature (710)..(710): n is a, c, t, g, unknown or other
  misc_feature (714)..(714): n is a, c, t, g, unknown or other
  misc_feature (718)..(718): n is a, c, t, g, unknown or other
  misc_feature (735)..(735): n is a, c, t, g, unknown or other
  misc_feature (755)..(755): n is a, c, t, g, unknown or other
  misc_feature (759)..(759): n is a, c, t, g, unknown or other
  misc_feature (796)..(796): n is a, c, t, g, unknown or other
  misc_feature (1006)..(1007): n is a, c, t, g, unknown or other
  misc_feature (1016)..(1017): n is a, c, t, g, unknown or other
  misc_feature (1133)..(1133): n is a, c, t, g, unknown or other
ttgaagagtttgatcatggctcagattgaacgctggcggcaggcctaacacatgcaagtcgngcggaagcacaggagagcttgctctctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggcncacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgnggttaataaccncagcaattgacgttacccgcagaagaagcaccggctaactccgtgccagcagccgcggtaatacggaggntgcaagcgttanncggaatnantgggcgtaaagcgtncgcaggcggtntgtnaagtcggatgtgaaatccccgggctcaacctgggaactgcattcgaaactggcaggctagagtnnngtagaggngggtagaattccnggtgtagcggtgaaatgcgtagagatcnggangaanaccngtggcgaaggcggcccnctggacaaagactgacgctnaggngcgaaagcgtggggagcaaacaggattagataccctngtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttnncagagatgnnttggtgccttcgggaactctgagacaggtgctgcatggctgtcgtcagctcgtgttgtgaaatgttgggttaagtcccgcaacgagcgcaacccttatcctttgttgccagcggtncggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 150 - DNA, 882 bp, Unknown
  Enterobacter sp.
  gene (1)..(882): nifH
atgaccatgcgtcaatgtgccatttacggcaaaggtggtatcggtaaatccactaccacgcaaaacctggtcgccgcgctggcggagatgggcaagaaagtaatgatcgtcggctgcgacccgaaagcagactccactcgtctgatcctgcatgcgaaagcgcagaacaccattatggagatggcggctgaagtcggctccgtggaagaccttgaactggaagatgtgctgcaaatcggttacggcgacgtacgctgcgcagaatccggcggcccggaaccaggcgttggctgtgctggtcgcggggtaattaccgccatcaacttcctggaagaagaaggcgcctatgttcccgacctcgatttcgtcttttacgacgtgttgggcgacgtggtgtgcggggggttcgccatgccgattcgcgaaaacaaagcgcaggagatctacatcgtctgctccggcgaaatgatggcgatgtacgccgccaacaacatctctaaaggcatcgtgaaatacgccaaatccggcaaagtgcgccttggcgggctgatctgtaactcccgtcagaccgaccgcgaagatgagctgatcatagcgctggcggaaaaactcggcacccagatgatccacttcgtgccgcgcgacaacatcgtgcaacgcgctgaaatccgccgtatgacggtgattgagtacgatccgaaatgcaaccaggccaatgaataccgcacgctggcgaacaagatcgtcaacaacaccaaaatggtcgtgccaacgcccatcaccatggacgaactggaagagctgttgatggaattcggcattatggatgtggaagacaccagcattatcggtaaaaccgccgcagaagaaaacgcggtttga

SEQ ID NO: 151 - DNA, 1449 bp, Unknown
  Enterobacter sp.
  gene (1)..(1449): nifD1
atgagcaatgcaacaggcgaacgtaatctggagatcatccaggaagtgctggagatctttccggaaaaaacgcgcaaagaacgcagaaagcacatgatggtgagcgacccggagatggaaagcgtcgggaaatgcatcatctccaaccgtaagtcgcagcccggcgtaatgaccgtgcgcggttgctcttacgccggttctaaaggggtggtattcgggccgatcaaagatatggcccatatttcccacggcccggtcggctgcggtcagtactcccgcgccgggcggcgtaactactacaccggcgtcagcggtgtggatagcttcggtacgctcaactttacctccgattttcaggagcgcgatatcgtgtttggcggcgataaaaagctgaccaaactgattgaagagatggagacgctgttcccgctgaccaaagggatctccattcagtccgaatgcccggtcggcctgattggcgacgacattgaagccgttgccaacgccagccgcaaagccatcaataaaccggtcattccggtgcgctgcgaaggttttcgcggcgtttcccagtcactcggtcaccacattgccaacgacgtgatccgcgactgggtactggataaccgcgaaggcaagccgtttgaggccggtccttatgacgtggcgatcatcggcgattacaacatcggcggcgatgcctgggcgtcgcgcattttgctcgaagagatgggcctgcgcgtggtggcgcagtggtccggcgacggcacgctggttgagatggagaacacgccgttcgtcaaactcaaccttgtgcactgctaccgctcaatgaactatatctcccgccatatggaggagaaacacggtattccgtggatggagtacaacttcttcggtccgaccaaagtcgccgaatcgttgcgcaaaatcgccgatatgtttgatgacaccattcgcgccaacgccgaagcggtgatcgccaaatatcaggcgcagaacgacgccatcatcgccaaataccgtccgcgtctggaaggccgcaaagtgctgctgtatatgggcggtttacgtcctcgccatgtgattggcgcttatgaagatctggggatggaaattatcgctgcgggttatgaattcgcccacaacgatgactacgaccgcaccctgccggatctgaaagaaggcaccttgctgttcgacgatgccagcagttatgaactggaagcctttgtcaaagcgctgaagccggatctgatcggctccggcattaaagagaagtacatcttccagaaaatgggcgtgccgtttcgccagatgcactcctgggattactccggcccctatcacggttatgacggctttgccatcttcgcccgcgatatggatatgacgatcaacaaccccgcgtggggccagttgaccgcgccgtggctgaaatccgcctga

SEQ ID NO: 152 - DNA, 1092 bp, Unknown
  Enterobacter sp.
  gene (1)..(1092): nifD2
  misc_feature (709)..(709): n is a, c, t, g, unknown or other
atgggacgcggcgagcgccgcctgttccatgccgtgcgccacatcgtcaaccgctaccacccggccgccgtctttatctataacacctgcgttcccgcgatggagggcgacgatatcgaagccgtctgccaggcggcagaaaccgccatcggcgtaccggtgattgccgttgatgtcgccgggttttacggcagcaaaaatctcggcaaccggttggccggtgaagtgatggtgaaaaaggtgattggcgggcgtgaacccgcgccgtggccggaagataccccttttgccccggcgcaccgccacgatatcgggctgattggcgaattcaatattgccggagagttctggcatattcagccgctgctcgatgagctgggtattcgcgtgctcggcagcctctccggcgacgggcgcttcagtgaaatccagacgctgcaccgggcgcaggtcaatatgctggtctgctccagggcgctgatcaacgtcgcccgctcgctggagcagcgctacggcacgccgtggtttgaaggcagtttttatggtgttcgcgccacctctgacgccctgcgccaactggcggcgctgaccggagaccgcgatctgatgcagcgcaccgaacagctcattgcccgcgaagagcagcaaacagagcaggcgctggccccgctgcgcgagcgcctgcgcgggcgcaaagcgctgctctatnccggcggcgtgaaatcctggtcggtggtttcggcgcttcaggatctgggcatggaagtggtggcgaccggcacgcgcaaatccaccgaagaggataaacagcgcatccgcgaactgatgggcgccgacgcgctgatgcttgatgaaggtaacgcccgctcgctgctggacgtggtttaccgctacaaggcggacatgatgatcgccgggggacgcaatatgtacaccgcctacaaagcgcggctgccgttcctcgatatcaatcaggagcgcgagcacgcctttgccggctaccgcggcattgtcaccctggccgaacagctctgcctgaccatggaaagcccggtctggccgcaaacccattcccgcgcaccgtggcaataa

SEQ ID NO: 153 - DNA, 846 bp, Unknown
  Enterobacter sp.
  gene (1)..(846): nifK
atgatggagcaaatggacgtgccgtgcagcctgctttccgatccctccgaagtgctggataccccggctgacgggcattaccacatgtatgcgggcggtacgacccagcaggagatgcgcgaagcgcctgacgctatcgacaccctgctgctgcaaccctggcaactggtgaaaaccaaaaaagtggtgcaggaaagctggaaccagcccgctaccgaggtgcaaatcccaatggggctggccggaaccgacgagctgctgatgacggtaagccagttaaccggcaaagccattccggatagcttagcgctggaacgcggtcggctggtggatatgatgctcgactcccacacctggctgcacggcaagaaattcggcctgttcggtgacccggattttgtcatggggctgacccgcttcctgctggaactgggctgcgaaccgacggtgattctgtgccataacggcagcaagcgctggcagaaagcgatgaagaaaatgcttgaagcctcgccgtacgggaaagagagcgaagtctttatcaactgcgatttgtggcatttccgctcgctgatgtttacccgtcagccggactttatgatcggcaactcctacgccaagtttatccagcgcgatacgctggcgaagggtgagcagtttgaagtgccgctgatccgcctggggttcccgctgttcgatcgccaccatctgcaccgccagaccacctggggttacgaaggggccatgagtatcctcaccacgctggttaatgcggtgctggagaaagtcgacagagagaccatcaagctcggcaaaaccgactacagcttcgatcttatccgttaa

SEQ ID NO: 154 - DNA, 1095 bp, Unknown
  Enterobacter sp.
  gene (1)..(1095): nifL
  misc_feature (942)..(942): n is a, c, t, g, unknown or other
atgcagcgcgacatcagcaccagctacgcgctggaacaacggctgcgcaatcatatgacgctgaccgaagccgtcttgaataacattccggcggcggttgtagtggtggatgaacgcgatcgggtggtgatggataacctcgcctacaaaaccttttgcgccgattgcggcggtaaagaactactcaccgaaatcaacttttccgcccataaggcggagctggcgcagggcctggtactgccggtagtgctgcgcggcaccgtgcgctggttgtccgttacctgttgggcgctgccgggcgtcagcgaagaagcaggccgctactttattgatagcgccgtgccgcgcacgctggtggtgatcaccgataatactcagcagcagcaacaacaggagcaggggcgtcttgatcgtctgaagcagcagataaccagcggtaaattgctggcggcgatccgcgaatcgctggacgccgcgctggtacaactcaattgcccaattaatatgctggccgccgcacgccgcttaaatggcgacgagcatagcaatctggcgctggatgccgcatggcgtgaaggcgaagaagcgatggcgcggttgcagcgctgccgcccgtcgctggaactggaaagcccggcagtctggccgctccagccgttccttgacgatctgcgtgccctgtatcacacccgatataaccagggcgaaaacctgcaaattgagctggaatcccccgacctggtgggctttggccagcgaacacaactgcttgcctgcctgagcctgtggctcgacagaaccctggatattgccgcggagctacgtgatttcacggtacagactcaactttacgcccgcgaagagagcggctggctgtcgttctatttaaacgacaatgtgccgctgattcaggtgcgctacacccattcacccgatgcactnaatgcgcccggtaaaggcatggagctgcggctgatccagacgctggtcgcccaccatcgaggcgcaatagaactgacctcacgccctcagggaggcacctgtctgatcctgcgtttcccattattttactcgctgacaggaggctcactatga

SEQ ID NO: 155 - DNA, 219 bp, Unknown
  Enterobacter sp.
  gene (1)..(219): nifA partial gene
atgactcagcgaaccgagtcgggtacaaccgtctggcgctttgacctctcccaacagtttacagccatgcagcgtatcagtgtggtgttaagccgcgcgacggagatcgggcagacgctacaggaagtgctgtgcgtgctgcacaacgatgcctttatgcagcacgggatgatctgtccgtacgcgcgggtgcgcgtcttcgcgagcgtatggctttga

SEQ ID NO: 156 - DNA, 1635 bp, Unknown
  Enterobacter sp.
  gene (1)..(1635): glnE
  misc_feature (234)..(234): n is a, c, t, g, unknown or other
  misc_feature (274)..(274): n is a, c, t, g, unknown or other
  misc_feature (1535)..(1535): n is a, c, t, g, unknown or other
atgcgcgtggaagactggtcaacgctgaccgaacggctcgatgcccatatggcaggcgtgcgccgaatctttaacgaactgatcggtgatgacgaaagtgagtcgcaggacgatgcgctctccgagcactggcgcgagctgtggcaggacgcgcttcaggaagatgacaccacgccggtgctgacgcacttaaccgacgacgcgcgccatcgcgtggtggcgctgatcgctganttccgtcttgagctgaacaaacgcgccatcggcccgcgtngtcgccaggtgctggatcacctgatgccgcacctgctgagcgaagtctgctcgcgtgccgatgcgccggtgccgctgtcgcggatgatgcccctgctgagcgggattatcacccgtactacctaccttgaactcctgagcgagttccctggcgcgcttaagcacctgatttcactctgcgccgcgtcgccgatggtggccaacaagctggcgcgttacccgctgctgctggatgagctgctcgatccgaataccctttatcaaccgacggcgaccgacgcctaccgggacgaactgcgtcagtatctgctgcgcgtgccggaagaagacgaagagcaacagctggaggcgctgcgtcagtttaagcaggcccagatgctgcgcgtggcggccgcagatattgccggaacgctgccggtgatgaaagtgagcgatcacttaacctggcttgcggaagcgattatcgacgcggtggtgcatcaggcctgggtgcagatggtggcgcgctatggccagccgaaacatctggctgaccgtgatggtcgcggcttcgcggtggtgggttacggtaagctcggcggttgggagctgggctatagctccgatctggatttaatcttcctccacgactgcccggttgatgtgatgaccgacggcgagcgcgagattgacgggcgtcagttctacctgcgcctggcgcagcgcatcatgcacctgttcagcacccgcacctcgtcgggcattttgtatgaagtggatgcccgtctgcgcccgtccggcgcggcgggcatgctggtcacctcgacggagtccttcgctgattaccagaagaatgaagcctggacgtgggagcatcaggcgctggtgcgcgcccgtgtggtgtatggcgatccgctgctgaaaacgcagtttgacgtgattcgtaaggaagtcatgaccaccgtgcgcgatggcagcacgctgcaaacggaagtgcgcgaaatgcgcgagaaaatgcgcgcgcacttaggcaataaacatcgcgatcgctttgatattaaagccgatgagggcggtattaccgatattgagtttattacccagtatctggtgttgctgcacgcgcatgacaagccgaagctgacgcgctggtcggataacgtgcgcattctggaactgctggcgcaaaacgacattatggacgagcaggaggcgcaggccttaacccgtgcctatacaacgcttcgcgatgagctccatcatctggcgttgcaggagcagcngggacacgtggcgctggactgtttcaccgctgaacgcgctcaggtaacggccagctggcagaagtggctggtggaaccgtgcgtaacaaatcaagtgtga

SEQ ID NO: 157 - DNA, 1316 bp, Unknown
  Enterobacter sp.
  gene (1)..(1316): 16S
  misc_feature (43)..(43): n is a, c, t, g, unknown or other
  misc_feature (247)..(247): n is a, c, t, g, unknown or other
  misc_feature (784)..(785): n is a, c, t, g, unknown or other
  misc_feature (794)..(795): n is a, c, t, g, unknown or other
agatgtgcccagatgggattagctagtaggtggggtaacggcncacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccncagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttnncagagatgnnttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 158 - DNA, 882 bp, Unknown; identical to SEQ ID NO: 150
  Enterobacter sp.
  gene (1)..(882): nifH

SEQ ID NO: 159 - DNA, 1449 bp, Unknown; identical to SEQ ID NO: 151
  Enterobacter sp.
  gene (1)..(1449): nifD1

SEQ ID NO: 160 - DNA, 1374 bp, Unknown
  Enterobacter sp.
  gene (1)..(1374): nifD2
atgaaggggaacgagatcctggctttgctcgatgaacctgcctgcgagcacaaccataaacagaaatccggctgcagcgcgccgaaacccggcgcgacagcgggcggctgcgcctttgacggtgcgcagatcaccctgctgccactctccgatgttgcccacctggtacacggccccattggttgtaccggtagctcatgggataaccgtggcagcttcagttccggcccgacgatcaaccggctgggttttaccaccgatctgagcgaacaggatgtgatcatgggacgcggcgagcgccgcctgttccatgccgtgcgccacatcgtcaaccgctaccacccggccgccgtctttatctataacacctgcgttcccgcgatggagggcgacgatatcgaagccgtctgccaggcggcagaaaccgccatcggcgtaccggtgattgccgttgatgtcgccgggttttacggcagcaaaaatctcggcaaccggttggccggtgaagtgatggtgaaaaaggtgattggcgggcgtgaacccgcgccgtggccggaagataccccttttgccccggcgcaccgccacgatatcgggctgattggcgaattcaatattgccggagagttctggcatattcagccgctgctcgatgagctgggtattcgcgtgctcggcagcctctccggcgacgggcgcttcagtgaaatccagacgctgcaccgggcgcaggtcaatatgctggtctgctccagggcgctgatcaacgtcgcccgctcgctggagcagcgctacggcacgccgtggtttgaaggcagtttttatggtgttcgcgccacctctgacgccctgcgccaactggcggcgctgaccggagaccgcgatctgatgcagcgcaccgaacagctcattgcccgcgaagagcagcaaacagagcaggcgctggccccgctgcgcgagcgcctgcgcgggcgcaaagcgctgctctataccggcggcgtgaaatcctggtcggtggtttcggcgcttcaggatctgggcatggaagtggtggcgaccggcacgcgcaaatccaccgaagaggataaacagcgcatccgcgaactgatgggcgccgacgcgctgatgcttgatgaaggtaacgcccgctcgctgctggacgtggtttaccgctacaaggcggacatgatgatcgccgggggacgcaatatgtacaccgcctacaaagcgcggctgccgttcctcgatatcaatcaggagcgcgagcacgcctttgccggctaccgcggcattgtcaccctggccgaacagctctgcctgaccatggaaagcccggtctggccgcaaacccattcccgcgcaccgtggcaataa

SEQ ID NO: 161 - DNA, 1563 bp, Unknown
  Enterobacter sp.
  gene (1)..(1563): nifK1
atgagccaaagtgctgagaaaattcaaaactgtcatccgctgtttgaacaggatgcgtaccagatgctgtttaaagataaacggcaactggaagaggcccacgatccggcgcgcgtgcaggaggtctttcaatggaccaccaccgccgagtatgaagcgcttaactttcaacgcgaagcgctgactatcgatccggccaaagcctgccagccgctgggtgcggtactgtgctcgctgggctttgccaataccctgccctatgttcacggctcccaggggtgcgtggcctatttccgcacctattttaaccgtcactttaaagagccgattgcctgtgtttctgactcgatgacggaagatgcggcagtattcggcggcaacaacaacctgaacaccgggttgcagaacgccagcgccctctacaagccggaaatcattgccgtctccaccacctgtatggcggaggtcatcggcgacgacctgcaggcgtttattgctaacgccaaaaaagacggctttatcgacgcggcgatcccggtgccttacgcgcacacgccaagctttatcggcagccatatcaccggctgggacaatatgtttgagggcttcgcccgtacctttaccgccgattacagcggacaaccgggcaaattaccgcgtatcaatctggtcagcggatttgaaacctatctcggtaatttccgcgtgctgaaacgcatgatggagcaaatggacgtgccgtgcagcctgctttccgatccctccgaagtgctggataccccggctgacgggcattaccacatgtatgcgggcggtacgacccagcaggagatgcgcgaagcgcctgacgctatcgacaccctgctgctgcaaccctggcaactggtgaaaaccaaaaaagtggtgcaggaaagctggaaccagcccgctaccgaggtgcaaatcccaatggggctggccggaaccgacgagctgctgatgacggtaagccagttaaccggcaaagccattccggatagcttagcgctggaacgcggtcggctggtggatatgatgctcgactcccacacctggctgcacggcaagaaattcggcctgttcggtgacccggattttgtcatggggctgacccgcttcctgctggaactgggctgcgaaccgacggtgattctgtgccataacggcagcaagcgctggcagaaagcgatgaagaaaatgcttgaagcctcgccgtacgggaaagagagcgaagtctttatcaactgcgatttgtggcatttccgctcgctgatgtttacccgtcagccggactttatgatcggcaactcctacgccaagtttatccagcgcgatacgctggcgaagggtgagcagtttgaagtgccgctgatccgcctggggttcccgctgttcgatcgccaccatctgcaccgccagaccacctggggttacgaaggggccatgagtatcctcaccacgctggttaatgcggtgctggagaaagtcgacagagagaccatcaagctcggcaaaaccgactacagcttcgatcttatccgttaa

SEQ ID NO: 162 - DNA, 1386 bp, Unknown
  Enterobacter sp.
  gene (1)..(1386): nifK2
atggcagaaattatccgtagtaaaaagccgctggccgtcagcccggtaaaaagtggccagccgctgggcgcgattctggcgagcatgggctttgaacagagcattccgctggttcatggcgctcaggggtgcagcgccttcgcgaaggtcttttttatccagcattttcacgatccgatcccgctgcaatcgacggcaatggacccgacatcgaccattatgggtgccgatgagaacatctttaccgcgctgaatgtgctgtgttcacgcaacaacccgaaagcgattgttctgctgagcactggcctttccgaggcgcagggcagcgatatttcgcgcgtggtgcgccagttccgcgatgaatatccgcgccataaaggggtggcgctgctgaccgtcaacacgccggatttttacggcagcctggaaaacggctacagcgcggtgctggagagcatggttgaacagtgggtgccggaaaaaccgcagccgggcgtgcgcaatcgccgcgtgaacctgctgctcagccatttgcttacgccgggcgacattgagctgctgcgaagttatgtcgaggcatttggcctgcagccggtgatggtgccggatctttcccagtcgctggatggccatctcgccagcggggatttctcgccaattacccagggcggcagcagcctgcggctgattgaacagatgggacagagtcttggcacgttcgccattggcgtatccctctcccgcgccgcgcaattgctggcgcagcgcagccatgcggaagtggtcaccctgccgcatctgatgaccatgagccagtgcgatacgtttattcatcaactgaagcgcctctccgggcgcgatgttccggcgtggatcgaacgccagcgcgggcaactgcaggatgcgatgatcgattgtcatatgtggttgcagggcgcgcctgtcgcgctggccgccgagggcgatctgctcgccgcctggtgcgatttcgcctgcgatatgggcatggtgcccggcccggtggtggcgccggtgagccagaaagggttgcaggatctgccggtcgaaaaagtcattatcggcgatctggaggatatgcaggatctgttgtgtgaaacgcctgcatcgctgctcgtctctaattctcacgccgctgatttggccgggcagttcgacattccgctggtgcgcgccggtttccccctgttcgaccgtctgggcgagtttcgccgcgtgcgccagggttacgccgggatgcgcgacaccttgtttgagctggcgaatgcgctgcgcgatcgccatcatcatcttgccgcttatcactcgccgctgcgccagcgtttttacgaacccgcatcttcgggaggtgactatgcaacatgttaa

SEQ ID NO: 163 - DNA, 1488 bp, Unknown
  Enterobacter sp.
  gene (1)..(1488): nifL
atgaccctgaatatgatgatggacgccaccgcgcccgccgagatcgccggagcgctctcacaacagcatcccgggttgtttttcaccatggttgaacaggcgcccgtcgcgatttcactgaccgatgccgatgcccacattctctacgccaaccccgcgttttgtcgccagtcggggtatgaactggaagagttgttgcagcaaaacccgcgcctgcttgccagtaagcagacgccgcgtgaaatctaccaggaaatgtggcacaccctgctgcaacaccgtccgtggcgcggacaactgatcaaccgtcgccgcgacggcagcctgtttctggtggaaatcgacatcaccccactgtttgatgcgttcggcaaactcgaacattacctggccatgcagcgcgacatcagcaccagctacgcgctggaacaacggctgcgcaatcatatgacgctgaccgaagccgtcttgaataacattccggcggcggttgtagtggtggatgaacgcgatcgggtggtgatggataacctcgcctacaaaaccttttgcgccgattgcggcggtaaagaactactcaccgaaatcaacttttccgcccataaggcggagctggcgcagggcctggtactgccggtagtgctgcgcggcaccgtgcgctggttgtccgttacctgttgggcgctgccgggcgtcagcgaagaagcaggccgctactttattgatagcgccgtgccgcgcacgctggtggtgatcaccgataatactcagcagcagcaacaacaggagcaggggcgtcttgatcgtctgaagcagcagataaccagcggtaaattgctggcggcgatccgcgaatcgctggacgccgcgctggtacaactcaattgcccaattaatatgctggccgccgcacgccgcttaaatggcgacgagcatagcaatctggcgctggatgccgcatggcgtgaaggcgaagaagcgatggcgcggttgcagcgctgccgcccgtcgctggaactggaaagcccggcagtctggccgctccagccgttccttgacgatctgcgtgccctgtatcacacccgatataaccagggcgaaaacctgcaaattgagctggaatcccccgacctggtgggctttggccagcgaacacaactgcttgcctgcctgagcctgtggctcgacagaaccctggatattgccgcggagctacgtgatttcacggtacagactcaactttacgcccgcgaagagagcggctggctgtcgttctatttaaacgacaatgtgccgctgattcaggtgcgctacacccattcacccgatgcactcaatgcgcccggtaaaggcatggagctgcggctgatccagacgctggtcgcccaccatcgaggcgcaatagaactgacctcacgccctcagggaggcacctgtctgatcctgcgtttcccattattttactcgctgacaggaggctcactatga

SEQ ID NO: 164 - DNA, 1575 bp, Unknown
  Enterobacter sp.
  gene (1)..(1575): nifA
atgactcagcgaaccgagtcgggtacaaccgtctggcgctttgacctctcccaacagtttacagccatgcagcgtatcagtgtggtgttaagccgcgcgacggagatcgggcagacgctacaggaagtgctgtgcgtgctgcacaacgatgcctttatgcagcacgggatgatctgtctgtacgacagtaagcaagcgatcctttccattgaagccttgcatgaggccgatcagcagttaattcccggcagttcacagattcgctaccgtccgggcgaagggctggtaggcacggtgctttcacagggacagtcgctggtactgccctgtgtctccgacgatcggcgttttctcgatcgcctgggattgtatgattacagcttgccgtttatcgccgtgccgctgatggggccaaactcgcagcctatcggcgtgctggccgcccagcctatggcgcgttacgaggagcggctgcccgcctgcacgcgttttcttgaaaccgtcgccaatctggtggcgcaaaccgttcgcctgatgacaccgcccagcgtcgcgtctccaccccgtgctgctgccgcgcagattgccagccagcgcgggtgcgcgtcttcgcgagcgtatggctttgaaaacatggtcggtaaaagcgcggctatgcgtcagacgctggaaattattcgccaggtatcacgctgggacaccaccgtgctggtgcgtggcgaaagcggaaccggtaaagagttgatagccaacgctatccaccacaattcaccgcgcgccgccgcgccgtttgtcaaattcaactgcgcggcgctgcccgatacgctgctggagagtgaactcttcggtcatgaaaaaggcgcgtttaccggcgcggtgcgccagcgcaaaggccgtttcgaactggcggatggcggtacgctgtttcttgatgagatcggcgaaagtagcgcctcgtttcaggcgaaattgctgcgtatcttgcaggaaggcgaaatggaacgcgtcggcggcgacgaaacgctgcgggtgaatgtacggatcattgccgccaccaaccgcaatctggaagaggaagtgcggctgggtaattttcgcgaagatctctactatcgccttaatgtgatgccgatctccctgcccccgctccgcgagcgtcaggaggacatcgtcgagctggcgcattttctggtgcgcaaaatcgcgcaaaaccagaaccgcacgctgcgcatcagcgatggcgcgatccgtttgttgatgagctatagctggcctggaaacgtgcgtgagctggaaaactgccttgagcgatcggcggtgatgtcggaaaacgggctgatcgatcgcgacgtgattttgtttcaccacagggaaaatctgccaaaaacgccacagaccagtgcgccgcgcgaagagagctggctcgatcagaacctcgatgagcgacaaagattgatcgccgcgctggagaaagccggttgggtacaggcaaaagccgcgcgcctgctgggaatgaccccgcgccaggtggcctatcgtattcagacgatggacattgccatgccgagattgtag

SEQ ID NO: 165 - DNA, 2856 bp, Unknown
  Enterobacter sp.
  gene (1)..(2856): glnE
atgccgctttcttcgcagttacagcagcagtggcagaccgtttgcgaacgtctgcctgagtcattaccggcgtcatcgttaagcgagcaggcaaagagcgtgctcgtcttcagtgattttgtgcaggaaagtatcaccgccaacccgaactggctggcggaacttgagaacgcaccaccgcaggcagaagagtggcggcactatgctggctggctgcaaactgtactcgaagacgttacggatgaggccacgctgatgcgcgtcctgcgccagttccgtcgtcgggtgatggtgcgcattgcctgggctcaggcgctggaactggtgagcgaagagagtacgctgcagcagttaagcgagctggcgcaaacgttgattgtcgccgcgcgagactggctctatgccgcctgctgtaaagagtggggcacgccgtgcagcgaggaaggggttcctcagccgctgttgattctggggatgggaaagctgggcggctgcgagctgaacttctcctctgatatcgacctgatttttgcctggccggagaacggctccacgcgcggaggccgccgcgagctggacaacgcgcagttctttacccgtctcggccagcgcctgattaaagcgctggatcagcccacgcaggacggttttgtttaccgcgtggacatgcgcctgcgtccgtttggcgacagcgggccgctggtgctgagctttgcggcgctggaagattattaccaggagcaaggtcgcgactgggagcgttacgcgatggtcaaagcgcggatcatgggcgacagcgacgacgcttatgccaacgagctgcgcgccatgctgcgtccgttcgtgttccgtcgctatatcgacttcagcgtcatccagtccctgcgaaatatgaaagggatgattgcccgcgaggtgcgccgccgtgggctgaaagacaatatcaagctcggtgcgggcggcatccgcgaaatcgaatttatcgtccaggtcttccagcttattcgcggcggacgcgagccgtcgctgcagtcccgttccttattaccgacgctgagcgccattgcgcagctgcatctcctgccggacggcgacgcgcaaaccctgcgcgaggcctatcttttcctgcgtcgtctggaaaacctgctgcaaagcattaatgacgaacagacccaaaccctgccgggcgacgaccttaaccgggcgcgtctggcctggggaatgcgcgtggaagactggtcaacgctgaccgaacggctcgatgcccatatggcaggcgtgcgccgaatctttaacgaactgatcggtgatgacgaaagtgagtcgcaggacgatgcgctctccgagcactggcgcgagctgtggcaggacgcgcttcaggaagatgacaccacgccggtgctgacgcacttaaccgacgacgcgcgccatcgcgtggtggcgctgatcgctgatttccgtcttgagctgaacaaacgcgccatcggcccgcgtggtcgccaggtgctggatcacctgatgccgcacctgctgagcgaagtctgctcgcgtgccgatgcgccggtgccgctgtcgcggatgatgcccctgctgagcgggattatcacccgtactacctaccttgaactcctgagcgagttccctggcgcgcttaagcacctgatttcactctgcgccgcgtcgccgatggtggccaacaagctggcgcgttacccgctgctgctggatgagctgctcgatccgaataccctttatcaaccgacggcgaccgacgcctaccgggacgaactgcgtcagtatctgctgcgcgtgccggaagaagacgaagagcaacagctggaggcgctgcgtcagtttaagcaggcccagatgctgcgcgtggcggccgcagatattgccggaacgctgccggtgatgaaagtgagcgatcacttaacctggcttgcggaagcgattatcgacgcggtggtgcatcaggcctgggtgcagatggtggcgcgctatggccagccgaaacatctggctgaccgtgatggtcgcggcttcgcggtggtgggttacggtaagctcggcggttgggagctgggctatagctccgatctggatttaatcttcctccacgactgcccggttgatgtgatgaccgacggcgagcgcgagattgacgggcgtcagttctacctgcgcctggcgcagcgcatcatgcacctgttcagcacccgcacctcgtcgggcattttgtatgaagtggatgcccgtctgcgcccgtccggcgcggcgggcatgctggtcacctcgacggagtccttcgctgattaccagaagaatgaagcctggacgtgggagcatcaggcgctggtgcgcgcccgtgtggtgtatggcgatccgctgctgaaaacgcagtttgacgtgattcgtaaggaagtcatgaccaccgtgcgcgatggcagcacgctgcaaacggaagtgcgcgaaatgcgcgagaaaatgcgcgcgcacttaggcaataaacatcgcgatcgctttgatattaaagccgatgagggcggtattaccgatattgagtttattacccagtatctggtgttgctgcacgcgcatgacaagccgaagctgacgcgctggtcggataacgtgcgcattctggaactgctggcgcaaaacgacattatggacgagcaggaggcgcaggccttaacccgtgcctatacaacgcttcgcgatgagctccatcatctggcgttgcaggagcagccgggacacgtggcgctggactgtttcaccgctgaacgcgctcaggtaacggccagctggcagaagtggctggtggaaccgtgcgtaacaaatcaagtgtga

SEQ ID NO: 166 - DNA, 1290 bp, Unknown
  Enterobacter sp.
  gene (1)..(1290): amtB
atgaagatagcaacacttaaaacgggtctgggttcgctggcactgctgccgggcctggcgctggctgctgcacctgcggtggcagacaaagccgataacgcctttatgatgatcagcaccgcgctggtgctgttcatgtccattccgggcattgcgctgttctatggcggcctgatccgtggcaaaaacgttctctccatgctgacgcaggttgccgtaacgttcgcgctggtctgcgtactgtgggtggtttacggttactcgctggctttcggcacgggcaacgcgttctttggtaacttcgactgggtgatgctgaaaaatattgaactgaccgcgctgatgggcagtttctaccagtatattcacgttgctttccagggctcgttcgcctgcattaccgtcgggctgattgtaggcgcgcttgccgagcgtattcgtttctctgcggtcctgatcttcgtggtggtctggctgacgctctcctatgtgccgattgcgcacatggtctggggtggcggtctgctggcgacgcatggcgcgctggacttcgcgggcggtaccgttgtgcacattaacgccgcggtagcgggtctggttggcgcatacctgattggcaaacgcgtgggcttcggtaaagaagcgttcaaaccgcacaacctgccgatggtcttcaccggtaccgcgatcctctactttggctggtttggtttcaacgccggctcagcaagtgccgcgaacgaaatcgccgcgctggccttcgtgaataccgttgtggccacggcaggtgcaatcctctcctgggtctttggcgagtgggctgtgcgcggtaaaccttctctgctgggtgcctgttcgggggcgattgctggtctggtcggtatcaccccagcatgtggttatgtcggtgtgggtggcgcgctgctggtcggcctggtgtcaggtctggcgggtctgtggggcgtgacggcgctgaaacgtattctgcgcgttgatgacccttgcgatgtgtttggcgtgcacggcgtgtgcggcatcgtcggctgtatcatgaccggtatctttgcagcgaaatcgctgggtggcgtgggctacgcagaaggcgtcaccatggcccatcaggtgctggtgcagctggaaagtattgctgtcaccgtggtgtggtctgccgttgtcgctttcattggctacaaactggcggacatgacggttggtctgcgcgtgccggaagagcaggaacgcgaaggtctggacgtcaacagccacggcgagaatgcgtataacgcatga

SEQ ID NO: 167 - DNA, 1299 bp, Azospirillum lipoferum
  gene (1)..(1299): 16S
  misc_feature (294)..(294): n is a, c, t, g, unknown or other
  misc_feature (299)..(299): n is a, c, t, g, unknown or other
  misc_feature (302)..(302): n is a, c, t, g, unknown or other
  misc_feature (309)..(310): n is a, c, t, g, unknown or other
  misc_feature (332)..(332): n is a, c, t, g, unknown or other
  misc_feature (346)..(346): n is a, c, t, g, unknown or other
  misc_feature (351)..(351): n is a, c, t, g, unknown or other
  misc_feature (438)..(438): n is a, c, t, g, unknown or other
  misc_feature (445)..(445): n is a, c, t, g, unknown or other
  misc_feature (454)..(454): n is a, c, t, g, unknown or other
  misc_feature (469)..(469): n is a, c, t, g, unknown or other
  misc_feature (477)..(477): n is a, c, t, g, unknown or other
  misc_feature (492)..(492): n is a, c, t, g, unknown or other
  misc_feature (504)..(504): n is a, c, t, g, unknown or other
  misc_feature (555)..(555): n is a, c, t, g, unknown or other
  misc_feature (775)..(775): n is a, c, t, g, unknown or other
gccgagagaggggcccgcgtcggattaggtagttggtgaggtaatggctcaccaagccttcgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgnagggngcnagcgttnntcggaattactgggcgtaaagngcgcgtaggcggcntgttnagtcagaagtgaaagccccgggctcaacctgggaatagcttttgatactggcaggcttgagttccggagaggatggtggaattcccngtgtagnggtgaaatncgtagatattgggangaacaccngtggcgaaggcggcnatctggacgganactgacgctgaggcgcgaaagcgtggggagcaaacaggattagataccctngtagtccacgccgtaaacgatgaatgctagacgtcggggtgcatgcacttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccaacccttgacatgtccactttgggctcgagagatngggtccttcagttcggctgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggaagcgaagtcgcgagatggagcaaatccccaaaagccgtctcagttcggatcgcactctgcaactcgagtgcgtgaagttggaatcgctagtaatcgcggatcagcacgccgcggtgaatacgttcccgggccttgtacacaccgcccgtcacaccatgggagttggttttacccgaaggtggtgcgctaaccgcaaggaggcagccaaccacggtaaggtcagcgactggggtgaagtcgtaacaaggtagccgtaggggaacctgcggctggatcacctccttt

SEQ ID NO: 168 - DNA, 897 bp, Azospirillum lipoferum
  gene (1)..(897): nifH
atggccaaagcgcctctgcgtcagatcgccttttacggcaagggcggtatcggcaagtccaccacctctcagaacacgctggccgcgctggtcgagctggatcagaggatcctgatcgtcggctgcgacccgaaggccgactcgacccgcctgatcctgcacgcaaaggcccaggacaccgtcctgcatctggccgccgaggccggctcggtcgaggatctggagctcgaggacgttctcaagatcggctacaagaacatcaagtgcgtcgagtccggcggtccggagccgggggtcggctgcgccggccgcggcgtcatcacctcgatcaacttcctggaagagaacggcgcctacgacgacgtggactatgtgtcctacgacgtgctgggcgacgtggtctgcggcggcttcgccatgccgatccgcgagaacaaggcccaggaaatctacatcgtcatgtccggcgagatgatggcgctgtacgccgccaacaacatcgccaagggcatcctgaagtacgcgcacagcggcggcgtccgtctcggcggcctgatctgcaacgagcgccagaccgacaaggaatgggatctggccgacgcgctggccaagcgcctgggctccaagctgatccacttcgtgccgcgcgacaacatcgtccagcacgccgagctgcgccgcatgacggtcatcgagtacgccccggacagcaagcaggccggcgaataccgcgcgctcgccaacaagatccatgcgaactccggccagggttgcatcccgaccccgatcaccatggaagagctggaagagatgctgatggacttcggcatcatgaagaccgaggagcagcagctcgccgagctcgccgccaaggaagcggcgaaggccggcgcctga

SEQ ID NO: 169 - DNA, 1440 bp, Azospirillum lipoferum
  gene (1)..(1440): nifD1
atgagcctgtccgagaacaccacggtcgacgtcaagaacctcgtcaacgaagtcctcgaagcctatcccgaaaaatcccgcaagcgccgcgccaagcacctgaacgtgctggaggccgaggccaaggactgcggcgtcaagtcgaacgtcaagtccatccccggcgtcatgaccatccgcggctgcgcctatgccggctccaagggcgtggtgtggggtccgatcaaggacatgatccacatctcccacggtccggtcggctgcggctactactcctggtccggccgccgcaactactacatcggcgacaccggtgtggacagctggggcacgatgcacttcacctccgacttccaggagaaggacatcgtcttcggcggcgacaagaagctgcacaaggtcatcgaggaaatcaacgagctgttcccgctggtgaacggcatctcgatccagtcggaatgcccgatcggcctgatcggcgacgacatcgaggctgtcgcccgcgccaagtcggcggaaatcggcaagccggtcatccccgtgcgctgcgaaggcttccgcggcgtgtcccagtcgctgggccaccacatcgccaacgacgccatccgagactgggtgttcgagaagacggaacccaaggccggcttcgtctccaccccctatgacgtcaccatcatcggcgactacaacatcggcggcgacgcctggtcgtcccgcatcctgctggaggagatcggcctgcgcgtgatcgcccagtggtcgggcgacggcacgctcgccgaactggagaacacgccgaaggccaaggtcaacctgatccactgctaccgctcgatgaactacatcgcgcgccacatggaagagaagttcaacattccttggatggaatacaacttcttcggcccgagccagatcgccgaatccctgcgcaagatcgccgctctcttcgacgacaagatcaaggagaacgccgagaaggtcatcgcccgctaccagccgatggtcgatgcggtcatcgccaagtacaagccgcggctcgaaggcaagaaggtcatgatctacgtcggcggcctgcgtccccgccacgtcgtcgatgcctaccatgacctcggcatggagatcaccggcaccggctacgagttcgcccacaacgacgactatcagcgcacgcagcactacgtgaaggaaggcacgctgatctacgacgacgtcaccgcgttcgaactggagaagttcgtcgaggcgatgcgtcccgacctcgtcgcgtcgggcatcaaggaaaagtacgtgttccagaagatgggcctgccgttccgccagatgcacagctgggactactccggcccgtaccacggctatgacggcttcgcgatcttcgcccgcgacatggacctggccatcaacaaccccgtctggggcgtgatgaaggccccgttctga

SEQ ID NO: 170 - DNA, 1419 bp, Azospirillum lipoferum
  gene (1)..(1419): nifD2
atgctccaggacaagatccaggatgtcttcaacgaaccgggctgcgcgaccaaccaagccaaatcggccaaggagaagaagaagggctgcaccaagtcgctgaaaccgggggcggcagccggcggctgcgcctatgacggggcgatgatcgtgctccagccgatcgccgacgccgcccatctggtccatggccccatcgcctgcctcggaaacagttgggacaaccgcggctccaaatcctccggctcgcagctctaccgcaccggcttcaccaccgatctgtcggaactggacgtcatcggcggcggcgagaagaagctctaccgcgccatcaaggagatcgttcagcaatacgacccgccggccgtcttcgtctatcagacctgcgtgcccgccatgaccggcgacgacatcgccgcggtctgcaagttcgccacgcagaagctgggcaagccggtgatcccggtggactcgccgggcttcgtcgggtcgaagaatctcggcaacaagctggccggcgaagccctgctggagcatgtcatcggcacggtcgaaccggactacaccaccccgaccgacgtctgcatcatcggcgaatacaaccttgccggcgagctgtggctggtcaagccgctgctggacgagatcggcatccgcctcctgtcctgcatttccggcgacggccgctaccgggaggtggcgcaggcccaccgcgcccgcgtcaccatgatggtgtgcagccaggcgctggtgaatgtcgggcgcaagatggaggagcgctacggcatcccctatttcgaggggtccttctacggcgtgtccgacatgtcggacaccctgcgcaccatgacccgcatgctggtggagcgcggcgccgacaagggcctgatcgaccgggcggagggcgtgatcgcgcgggaggaaagccgggtctggcgccggctggaaccctacaagccgcgcttcgacggcaagcgcgtccttctcttcaccggcggcgtcaagagctggtcgatggtcagcgcgctggagggtgcggggctgaccatcctcggcacctccaccaagaaatcgaccagggaggacaaggagcgcatcaagaagatgaagggcgaagagttccaccagtgggacgatttgaagccgcgcgacatctacaggatgctggccgacgatcaggccgacatcatgatgtccggcggccgctcgcagttcatctcgctgaaggccaaggttccctggctcgacatcaaccaggagcgccaccacgcctatgccggctatgacggcatcgtcaatctctgcgaggagatcgacaaaacgctgtcgaatccgatctggcgtcaggtgcgtcagccggcaccgtgggagtccggcgcgtcctccacccttctggcttcctcgatggcggcggagtga

SEQ ID NO: 171 - DNA, 1383 bp, Azospirillum lipoferum
  gene (1)..(1383): nifK
atgtcccacatccagcgcttcccctccgccgccaaggccgcctccaccaacccgctgaagatgagccagccgctgggtgcggctctggcctatctcggcgtcgaccgctgcctgccgctgttccatggctcgcagggctgcaccgccttcgggctggtcctgctggtgcgccatttccgcgaggcgatcccgctccagaccacggcgatggatcaggtcgccaccatcctcggcggctacgacaatctggagcaggcgatccgcaccatcgtcgagcgcaaccagcccgccatgatcggcgtcgccaccaccggcgtcaccgagaccaagggcgaggatatggccggacagtacacgctgttccgccagcgcaaccccgacttggccgacacggccctggtcttcgccaacacccccgacttcgccggcggcttcgaggacggcttcgccgccgcggtcaccgcgatggtcgagcggttggtcgaaccgtcgccggtgcgcatcccgacccaggtcaacgtgctggccggctgccatctgtcccccggcgacgtggaggaactgcgcgacatcatcgaaggcttcggcctgtcgccgatcttcctgcccgacctgtcgctgtcgatggcgggccgccagccggccgacttcaccgccacctcgctgggcggcgtgaccgtcgatcagatccgcgccatgggcgcttcggccctcaccatcgtggtcggtgagcatatgcgggtggccggtaacgcgctggagctgaagaccgacgtgcccagccatttcttcaaccgcctgaccgggctggaggcgacggacaagctggtccggctgctgatggagttgtcgggcaagccggcgcccgcccggctgcggcgccagcgcgaaagcctggtcgatgccatgctcgacgggcatttcttctacagccgcaagcgcatcgccgtcgcgctggagcccgacctgctctatgccgtcaccggcttcctcgccgacatgggggccgaggtgatcgccgcggtgtccccgacgcagagcccggtgctggagcggttgaaggccgccaccatcatggtcggcgatcattccgacgtggagacgctggcccgcgacgccgacctgatcgtctccaactcgcacgggcggcagggagccgcgcggatcggcgtggctctgcaccgcatgggcctgccgctgttcgaccggctgggggccggcctgcgcgtccaggtcggctaccgcggcacgcgggaactgctgtgcgacatcggcaacctgttcctcgcccgcgagatggaccacgagcacgggcacgagagccacgaccacggggaatcccacggctgcggaggcggatcatgcggatgcaacgccgtctga

SEQ ID NO: 172 - DNA, 1560 bp, Azospirillum lipoferum
  gene (1)..(1560): nifK1
atgaccgacaagctttcgcagagcgccgacaaggtcctcgaccactacaccctcttccggcagcccgaatacgcggcgatgttcgagaagaagaagaccgagttcgagtacggccattcggacgaggaagtcgcccgcgtgtccgaatggaccaagtccgaggactacaaggcgaagaacttcgcccgtgaagcggtcgtcatcaacccgaccaaggcctgccagccgatcggcgcaatgttcgccgcccagggcttcgaaggcaccctgcccttcgtccacggctcccagggctgcgtcgcctattaccgcacccacctgacccgtcacttcaaggagccgaacagcgcggtctcctcgtcgatgacggaggacgcggcggtgttcggcggcctgaacaacatgatcgacggcctggcgaacgcctatgcgctctacaagccgaagatgatcgcggtgatgaccacctgcatggccgaagtcatcggcgacgatttgcagggcttcatcgccaatgcgaagaccaaggacagcgtcccggccgacttcccggtcccctacgcccacaccccggccttcgtcggcagccacatcgtcggctacgacaacatgatcaaggggatcctgaccaacttctggggtacgtcggagaatttcgacacacccaagaccgagcagatcaacctgatcccgggcttcgacggcttcgccgtcggcaacaaccgcgaactgaagcgcatcgccggcgaattcggcgtgaagctgcaaatcctgtccgacgtgtccgacaatttcgacacgccgatggatggcgagtaccgcatgtatgacggcggcaccaccatcgaggagaccaaggaggccctgcacgccaaggccaccatctccatgcaggagtacaacacgacccagaccctgcaattctgcaaggagaagggtcaggaagtcgccaagttcaactacccgatgggcgtcaccggcaccgacgagctgctgctgaagctcgccgaactgtcgggcaagccggtcccggccagcctgaagctggagcgcggccgtctggtcgacgccatcgccgacagccacacccacatgcacggcaagcgcttcgccgtctatggcgacccggacttctgcctgggcatgtccaagttcctgctggagctgggtgcggagccggtgcacatcctgtcgacgtcgggctccaagaagtgggagaagcaggtccagaaggtgctggacggctcgcccttcggcgcctcgggcaaggcccatggcggcaaggatctgtggcacctgcgttcgctgatcttcaccgacaaggtggactacatcatcggcaacagctacggcaagtatctggagcgcgacaccaaggttccgctgatccgcctgacctacccgatcttcgaccgccaccaccaccaccgctacccgacctggggctaccagggcgcgctgaacgtgctggtacggatcctggaccggatcttcgaggacatcgacgccaacaccaacatcgtcggccagaccgactactcgttcgacctgatccgctga

SEQ ID NO: 173 - DNA, 1530 bp, Azospirillum lipoferum
  gene (1)..(1530): nifA
atgttgacctctgatattgttggcaaattgcgctgcatcgcagcagaccccaaagcgggcatcgcaaggggcctcgacaccgggacgacgaagatcggtcccgtttgggagggtgacgtgggcgacaccgtggatttcgaagcgctgcgccagcgggcggtccactccctgttcgaacatctggaatccatgtgcgtcggcgccgtcgccgtcgaccacaccggccgcatcgcctggatggacgagaagtacaaggctctgctgggcgttcccgacgacccgcgcggccggcaggtggaggacgtcatccccaacagccagctgcgccgggtgatcgacagcggccagccgcagccgctggacatcatggagttcgacgaccggtccttcgtggtgacgcggatgccgctgttcggcaccgacggttcgatcatcggcgccatcggcttcgtgctgttcgaccgcgccgaatatctccgcccgctggtccgcaaatacgagaagatgcaggaggagctggcccgcacccagcaggagctggcgcatgagcgccgcgccaaatactccttctcgcagttcctgggcgccagcgaatcgatccgcgagatcaagcggctggggcgccgcgccgcccagatggattcgaccgtcctgctgctgggcgaaaccgggaccggcaaggagctgctggcccaggccatccattccgccagcccgcgggcgtccaagcccttcgtcggcgtcaatgtcgccgccattccggaaaccctgctggaggcggagttcttcggcgtcgcccccggcgccttcaccggcgccgaccgccgccaccgcgacggcaagttccagctcgccaacggcggcaccctgttcctcgacgagatcggcgacatgccgctgccggtgcaggccaagcttctgcgcgtgctgcaggagcgggagatcgagccgctcggctccaacaaggtggtgcgggtcgatgtccgcatcatcgccgccaccagccgtgacctgcacgccctggtgcgtgagaagcagttccgcgccgacctctattaccggctgaatgtggtgccgatcaccctgccgccgctgcgcgaccggccggaggacatcgagagcatcgccgaccgcatcctggaacagctggcgatccagcagggcacgccgccgcgcgagctgctggaatcggcggtgcaggtgctgcgcgactatgactggcccggcaatgtgcgcgagctttacaacacgctggaacgggtggtggcgctgaccgatgcgccgatcctgaccgcgccgcacatccgcagcgtgctgcccggccagcatccggccggcgcgtcggccctgccgctggcggccggcgcgcggccgttgcaggaggtgctgcacgccgccgagcgccacgccatcgccgcggcgcttgaggaggcgaacggcgtcaaggcgcgggcggcgaagctgctgggcatttcgcgcgcgtcgctgtacgaacgcatggtgacgctggggttgggggcgacgcagtag

SEQ ID NO: 174 - DNA, 3030 bp, Azospirillum lipoferum
  gene (1)..(3030): glnE
atgccgagtcccatcgcgttctcaagccccttgccgaagcctttcgacagcgcgcaggcggcgctggggatggagcgctggcgccagcaggccgccgcggcggagccggagacccgcgcctgggcggaagccttcgccgattcggagaccggccgggcgctgatcggggcggtgtgcggcaacagcccgtatctcggccacagcctgacgcgggagttgcccttcgtcgcccgtacagtgcaggacggcttcgacgacaccttcgccgcgctgatcgccgctctccatgccgagcatggcgaggagaaatcgatggaccggctgatggccggcctgcgggtggcgaagcggcgggcggcgctgctgatcgcgctggccgacatcgccggcgcgtggccgctgttccgcgtcaccggcgccctgtcggagctggcggagacgggggtgcagctggccgcgaatttcctgctgcgccgcgccagggaggcggggacgctgacgctgccggatccgcagcgaccgtgggtcggttcgggcctgatcgttttgggcatgggtaagcttggcgggcgcgaactcaactattccagcgacatcgacctgatcgtcctgtatgacgacgctgttgtgcagacgccccagccggacaacctcgcgcgaaccttcatcaggctcgcacgcgatcttgtccgcattatggatgaacggaccaaggacggctacgtcttccgcaccgaccttcggcttaggcccgatcccggcgccacgccgctggcggtttccgtctccgcagccgaaatttattacggcagcgtcggtcagaactgggaacgcgcggcgatgatcaaggcccgtcccatcgccggcgatctggaggcgggcgcctcctttgtccgcttcctggagcccttcgtctggcgccgcaacctggatttcgccgccatccaggacatccattcgatcaaacgccagatcaacgcccacaagggccaccgcgaggtgacggtcaacggccacgacatcaaggtcggccgcggcggcatccgcgagatcgagttcttcgcccagacccagcagctgatcttcggcgggcgcgacccgcgcgtgcgaatcgctccgaccctgatggcgaacgaggcgctgcgcgacgtcggccgcgtgccgccgcagacggtggaagagcttgccggggcctatcatttcctgcgccgtgtcgaacatcgcatccagatgatcgacgaccagcagacccatcgtattcccgccgacgatgccggggtggcgcatttggccaccttcctcggctatgacgaccccgccgccttccgggcggaactgctggcgacgctggggcaggtggaggaccgctatgccgagctgttcgaggaggcgccgtcgctttccggccccggcaatctggtcttcaccggcaccgaccccgatccgggcacgatggagacgctgaagggcatgggcttcgccgatccggcccgcgtcatcagcgtggtgtcggcctggcatcgcggccgctaccgcgccacccggtcgggccgggcgcgggagctgctgacggagctgacgccggccctgctgagtgcgctgaccaagaccccggcccccgattcggcgctgatgaacttcgacgatttcctcggcaagctgccggccggcgtcggtctgttctcgctgttcgtcgccaatccctggctcctggagctggtggcggagatcatgggcatcgcgccgcagatggcgcagacgctgtcgcgcaacccgtcgctgctcgacgccgtgctgtcgccggacttcttcgacccgctgccgggcaaggaggacgggctggccgacgaccacgcccgcgtgatggcgccggcccgcgatttcgaggatgcgctgaccctgtcgcggcgctggaccaacgaccagcgcttccgcgccggggtgcatatcctgcgcggcatcaccgatggcgaccgctgcggcgccttcctggccgatctggccgacatcgtcgtccccgaccttgcccgccgggtggaggaggagttcgcccagcgccacggccatattcccggcggcgcctgggtggtggtggcgatgggcaagctcggcagccggcagctgaccatcacgtccgacatcgacctgatcgtcatctacgatgtggcgccgggccaagggggcgggggcggtccccgcttgtcggatggtgccaagccgctgtcgcccaacgagtattacatcaagctgactcagcgtctgaccaacgccattaccgcgccgatgggcgacggccggctctacgaggtcgacatgcggctgcgcccgtcgggcaacgccgggccgctcgccacctcgctggacgctttcctgaaatatcaggcgaccgatgcctggacctgggagcatatggccctgacccgcgcccgggtgatcggcggtgatgcggagctggccgggcgggtgtcggcagcgatccgctcggtgctgacggcgccgcgcgatgccgaccggctgctgtgggacgtggccgacatgcggcggcggatcgagaaggagttcgggacgaccaatgtctggaacgtcaaatacgcccgcggcggcctgatcgacatcgagttcatcgcccagtacctgcaactgcgccatggtcacgagcggccggacatcctgcacatcggcaccgccaaggcgctgggctgcgccgcccggacgggcgcgctggcgccggaggtggcggaggatctggagacgacgctgcggctgtggcggcgggtgcagggctttctgcggttgaccaccgccggggtgctcgatcccaatcaggtgtcgcccagcctgctggccgggctggtccgcgccgcctttcctgctgactttcagggcgagcgtgagcctggcactgttgacttccccgaactggaccacaaaatccgtgccgtcgccgcccgcgcccatggtcatttcaagaccctggtcgaggaaccggcgggccgtctggccccacccgccaccacgcctccagcctga

SEQ ID NO: 175 - DNA, 1440 bp, Azospirillum lipoferum
  gene (1)..(1440): amtB1
atgaaccgtctgttccttatggccgcaccgatgatggcggttgctctgggcgcggtcggcatgccggccgcagcccttgcccaggatccggcggctgccgccgctgccgcggctgcggctgcggctgccgccgctgctgccgcaccggcggctccggcgctgaatggcggcgacaccgcctggatgctcatctccaccgcgctggtgctgatgatgaccatccccggcctggcgctgttctacggcggcatggtccgcaagatgaacgtgctgtcgacggtgatgcagagcttcgccatcacctgcctgatcagcgtcctgtggtacgtcatcggctacagcctggccttcaccggcaccggtgcctatgtcggcggtctcgaccggctgttcctcaacgggctcgacttcacgaaggccttcgtgctgggcgaggcgaccgggtcgggcgtcccgacgaccatccccgagccggtcttcatgatgttccagatgacctttgcgatcatcaccccggccctgatcaccggcgccttcgccgaccgcatgaagttctcctccctgctggtcttcaccgcgctgtggtcgatcgtggtctatgcgccgatcgcccactgggtctggtacccgtcgggcttcctgttcggcctgggcgtgctggacttcgccggcggcacggtcgtgcacatcaacgccggcgtcgccggcctggtcgccgcgctggtgatcggcaagcgcaagggctacccgaaggaagccttcatgccgcacaacctggtgctgtcgctgatcggcgcctcgctgctgtgggtcggctggttcggcttcaacgccggttcggccctgaccgccggtccgcgtgccggcatggcgctggccgccacgcacatcgccaccgccggtgccgccatgggctggctgttcgcggagtggatcgtcaagggcaagccgtcgatcctcggcatcatctccggcgccgtcgccggcctggtcgcggtgaccccggccgccggcttcgtcgacccgacgggcgccatcgtcatcggcatcgtcgccggcgtggtctgcttctggtcggccaccagcctcaagcacatgctgggctatgacgacagcctggacgccttcggcgtgcacggcgtcggcggcctgatcggcgccatcctgaccggcgtcttcgccaagatgtcggtgtccaacagcgaaggcggcttcgcctccgtcctgcaggccgacccgaaggccacgctgggcctgctggaaggcaacgccgccgccgtctggatccaggtccagggcgtcctctacaccatggtctggtgcgccatcgccaccttcgtcctgctgaagatcgtcgatgtggtcatgggcctgcgcgtcgaagaggatgtggagcgcgacggtctcgacctcgccctgcatggcgagagcatccactaa

SEQ ID NO: 176 - DNA, 1227 bp, Azospirillum lipoferum
  gene (1)..(1227): amtB2
atggatgcggcaaagacgggtggcgacgtccttttcgtgctgatgggcgcggtgatggtgctggcgatgcattgcggcttcgccctgctggaggtcgggacggtccggcgcaagaatcaggtcaacgcgctggtgaagatcctgtcggacttcgccatgtcgaccatcgcctattttttcgtcggttatgccgtggcctacggcatcgacttcttcgccgacgcccacacgctggtcggcaagggaagcggcgggttcgcggcctatggctacgatctggtgaagttcttcttcctggcgaccttcgccgccgcggtgccggccatcgtctcgggcggcatcgccgagcgtgctaggttctggccgcaggccgccgccacgctggcgctgatcgcgctgttctatccattgctggaaggcacggtctggggcacccgcttcggcctgcaaagctggatggccgcgaccttcggccagcctttccacgacttcgccggatctgtggtggtgcatgccttcggcggctgggtggcgctgggtgccgtgctgaacctcggcaaccgccgcggccgctaccgtccgaacggctcgctgatcgccattccgccgtcgaacatccccttcctggcgctgggcgcctgggtgctgtgcgtggggtggttcggcttcaacgtgatgagcgcccaggtgctggatggcgtgacgggtctggtggcgctgaactcgctgatggcgatggtcggcggcatcgtcacctcgctggtgatcagccgcaccgatcccggcttcgtccacaacggcgcgctggccggtctggtggcggtctgcgccgggtccgacgtgatgcacccgctgggcgcgctggtcaccggcggcatcgccgggctgctgttcgtctgggccttcaacaaatgccagatcgactggaagatcgacgacgtgctgggcgtctggccgctgcacggtctgtgcggcctgaccggcggcctgctggccggcgtcttcgggcaggaggcactgggcggccttggcggcgtgtcgatcctcagccagatcgtcggcacggcaagcggcgccagcttcggattcgtctcgggtctggcggtctacggcctgctgcgcgtcaccgtcggcatccgcctcgatcccgagcaggagtacaagggcgccgacttgtcgttgcaccatatcaccgcgtacccggaagaggacgcgccgaccctgtaa

SEQ ID NO: 177 - DNA, 613 bp, Artificial Sequence
  Synthetic polynucleotide
  misc_feature (1)..(613): delta-nifL::PinfC
atgaccctgaatatgatgatggattcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatga

SEQ ID NO: 178 - DNA, 1613 bp, Artificial Sequence
  Synthetic polynucleotide
  misc_feature (1)..(1613): delta-nifL::PinfC with 500bp flank
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggattcttggttctctggagcgctttatcggcatcctgactgaagaatttgcaggcttcttcccaacctggcttgcacccgtgcaggtagttgtgatgaacatcactgattcgcaggctgaatacgttaacgaattgacccgtaaactgcaaaatgcgggcattcgtgtaaaagcagacttgagaaacgagaagattggctttaaaatccgcgagcacactttacgtcgtgtcccttatatgctggtttgtggtgacaaagaggtcgaagccggcaaagttgctgtgcgtacccgtcgcggtaaagacctgggtagcctggacgtaaatgatgttatcgagaagctgcaacaagagattcgcagccgcagtcttcaacaactggaggaataaggtattaaaggcggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtc

SEQ ID NO: 179 - DNA, 1185 bp, Artificial Sequence
  Synthetic polynucleotide
  misc_feature (1)..(1185): glnE-delta-AR-2
tccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaa

SEQ ID NO: 180 - DNA, 2085 bp, Artificial Sequence
  Synthetic polynucleotide
  misc_feature (1)..(2085): glnE-delta-AR-2 with 500bp flank
taaagcgagcgctcacttacgtgatctgttgacgcagtccgaagcgaccattacttcagccgtttcagcagatacggcggtgtggagtgcgcaatcagccctggcgaaactggtgctcaccgagtggttagtgacgcagggctggcgaaccttccttgatgaaaaagcgcaggctaagtttgccgactcctttaaacgctttgctgacgttcatctgtcacgcagcgccgccgagctgaaaaaagcctttgcccagccgctgggcgacagctatcgcgaccagttaccgcggctggcgcgtgatatcgacagcgcgttattgctggccggacattacgatcgcgcgcgcgccgtggagtggctggaaaactggcaggggcttcagcacgctattgaaacgcgccagagagttgaaatcgaacatttccgtaataccgccattacccaggagccgttctggttgcacagcggaaaacgttaacgaaaggatatttcgcatgtccctgtgcgccgcgtcgccgatggtggccagccaactggcgcgctacccgatcctgctcgatgaactgctcgacccgaacacgctctatcaaccgacggcgatgaacgcctatcgcgatgaactgcgacaatacctgttgcgcgtgccggaagaggatgaagagcagcaactggaggcgctacggcagtttaagcaggcgcagttgttgcgcgtagcggcggcggatatcgccggtacgttacccgtcatgaaagtgagcgatcacttaacctggctggcggaagcgattatcgatgcggtggtgcagcaagcctggaaccagatggtggcgcgttacggccagccgacgcatctgcacgatcgcgaagggcgcggtttcgccgtggtcggttacggcaaacttggcggctgggaattaggttacagctccgatctggatctggtgttcctgcacgactgccccatggatgtgatgaccgatggcgagcgtgaaatcgatggccgccagttctatttgcgcctcgcgcagcgcgtgatgcacctgttcagcacgcgcacgtcgtccggcattctttatgaagtcgatgcgcgtttgcgcccgtccggcgcggccggaatgctggtgaccactgcggaagcgttcgccgattatcaaaaaaatgaagcctggacatgggagcatcaggcgctggcgcgtgcgcgcgtggtgtacggcgatccgcaactgaccgccgaatttgacgccattcgccgcgatatcctgatgacctcccgcgatgccgctaccctgcaaaccgaagtgcgggaaatgcgtgagaaaatgcgcgcccatcttggtaacaagcacaaagaccgtttcgatctgaaagccgatgaaggcggtatcaccgatattgagtttatcgctcagtatctggtgctgcgctttgcccatgagaagccgaaactgacgcgctggtcggataatgtgcgcatcctcgaagggctggcgcaaaacggcatcatggatgagcaggaagcgcaggcattgacgctggcgtacaccacgttgcgtgatgagctgcaccacctggcgctgcaagagctgccaggacatgtggcgctctcctgttttgtcgccgagcgtgcgcttatcaaaaccagctgggacaagtggctggtggaaccgtgcgccccggcgtaagtgtggtatcatcgcgcgcaaattttgtatctctcaggagacaggaatgaaagttacgctgccagagttcaatcaagccggtgtcatggtggtgggtgatgtgatgctggatcgctactggtacggcccaaccagccgcatttctccggaagcgccagttccggttgttaaagtcgatactattgaagagcgaccgggcggtgcggcaaacgtggcgatgaacattgcctcgctgggcgcaacggcgcgtctggttggcctgactggcattgatgatgcggcgcgcgcgctgagcaaagcgctggcggatgttaatgttaaatgtgacttcgtttctgttccgactcaccccaccatcactaagctgcgcgtgctgtcgcgtaaccagcaactgattcgc

SEQ ID NO: 181 - DNA, 461 bp, Artificial Sequence
  Synthetic polynucleotide
  misc_feature (1)..(461): delta-nifL::Prm1
atgaccctgaatatgatgatggatgccagccgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatga

SEQ ID NO: 182 - DNA, 1461 bp, Artificial Sequence
  Synthetic polynucleotide
  misc_feature (1)..(1461): delta-nifL::Prm1 with 500bp flank
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggatgccagccgttctgtaataataaccggacaattcggactgattaaaaaagcgccctcgcggcgctttttttatattctcgactccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggtc

SEQ ID NO: 183 - DNA, 1185 bp, Artificial Sequence; identical to SEQ ID NO: 179
  Synthetic polynucleotide
  misc_feature (1)..(1185): glnE-delta-AR-2

SEQ ID NO: 184 - DNA, 2085 bp, Artificial Sequence; identical to SEQ ID NO: 180
  Synthetic polynucleotide
  misc_feature (1)..(2085): glnE-delta-AR-2 with 500bp flank

SEQ ID NO: 185 - DNA, 461 bp, Artificial Sequence; identical to SEQ ID NO: 181
  Synthetic polynucleotide
  misc_feature (1)..(461): delta-nifL::Prm1

SEQ ID NO: 186 - DNA, 1461 bp, Artificial Sequence; identical to SEQ ID NO: 182
  Synthetic polynucleotide
  misc_feature (1)..(1461): delta-nifL::Prm1 with 500bp flank

SEQ ID NO: 187 - DNA, 1185 bp, Artificial Sequence; identical to SEQ ID NO: 179
  Synthetic polynucleotide
  misc_feature (1)..(1185): glnE-delta-AR-2

SEQ ID NO: 188 - DNA, 2085 bp, Artificial Sequence; identical to SEQ ID NO: 180
  Synthetic polynucleotide
  misc_feature (1)..(2085): glnE-delta-AR-2 with 500bp flank

SEQ ID NO: 189 - DNA, 452 bp, Artificial Sequence
  Synthetic polynucleotide
  misc_feature (1)..(452): delta-nifL::Prm7
atgaccctgaatatgatgatggatgccagccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatga

SEQ ID NO: 190 - DNA, 1451 bp, Artificial Sequence
  Synthetic polynucleotide
  misc_feature (1)..(1451): delta-nifL::Prm7 with 500bp flank
accggataagagagaaaagtgtcgacgtcggtccggttgatattgaccggcgcatccgccagctcgcccagtttttggtggatctgtttggcgattttgcgggtcttgccggtgtcggtgccgaaaaaaataccaatatttgccataacacacgctcctgttgaaaaagagatcccgcggggaaaatgcggtgaacatgtcagctattgcgaagagtgtgccagttttgctcacgggcaaaagctgcaccagaatgggtattaatgcaccagcctggcgctttttttcgcggcacgtcccctcgctaatgcccgtctggcgcggctttgacgctgataaggcgctgaataccgatctggatcaaggttttgtcgggttatcgtccaaaaggtgcactctttgcatggttataagtgcctgacatggtgtccgggcgaacgtcgccaggtggcacaaattgtcagaactacgacacgactaaccgaccgcaggagtgtgcgatgaccctgaatatgatgatggatgccagccgcgtcaggttgaacgtaaaaaagtcggtctgcgcaaagcacgtcgtcgtccgcagttctccaaacgttaattggtttctgcttcggcagaacgattggcgaaaaaacccggtgcgaaccgggtttttttatggataaagatcgtgttatccacagcaatccattgattatctcttctttttcagcatttccagaatcccctcaccacaaagcccgcaaaatctggtaaactatcatccaattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatgacccagcgaaccgagtcgggtaataccgtctggcgcttcgatttatcccagcagttcaccgcgatgcagcggataagcgtggttctcagccgggcgaccgaggttgaacagacactccagcaggtgctgtgcgtattgcacaatgacgcctttttgcagcacggcatgatctgtctgtacgacagccagcaggcgattttgactattgaagcgttgcaggaagccgatcagcagttgatccccggcagctcgcaaattcgctaccgtccgggtgaagggctggtcgggacggtgctttcgcaggggcaatcgttagtgctggcgcgtgtggctgacgatcagcgctttcttgaccgcctgggactgtatgattacaacctgccgtttatcgccgtgccgctgatagggccggatgcgcagacttttggcgtgctgacggcgcaaccgatggcgcgttacgaagagcggttacccgcctgcacccgctttctggaaacggt

SEQ ID NO: 191 - DNA, 1191 bp, Artificial Sequence
  Synthetic polynucleotide
  misc_feature (1)..(1191): glnE-delta-AR-2
atggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 192 - DNA, 2191 bp, Artificial Sequence
  Synthetic polynucleotide
  misc_feature (1)..(2191): glnE-delta-AR-2 with 500bp flank
cgtaaggcgaccacccagctccgcgcgttgctgaacgacgctgaagccgttctgctggccgcggacaccgccgacgaggcgttattccgcaccgaggtcgtcggcgccaaactggccctgactgaatggctggtccagcgcggctggcgtccgttcctcaacgaggcaggagagaaaaaaatagccggatcgttcaaacggtttgccgatattaacctctcgcgggtggcggccgagctgcgcagcgccgtgcagcatctggcggttgaagatgccgccgaccagttgccgaagctgtcccgcgacatcgacagcgtccagctgctggcgggcgcctatggcgacgccgtcgcgccgtggctggagaactggcaggagcttcaccgtgcaatagcacatgacgatcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacatcgcctccctgggggcaacgtcgcgcctggtgggattgaccgggattgatgacgctgcccgcgcgctgagccaggcgctggccaatgtgaatgtgaagtgcgacttcgtctccgtcccgactcacccgaccatcaccaagctgcgggtgctgtcgcgcaatcagcagctgatccgcctcgactttgaagagggcttctccggcgtggatccgcagccgatgcatgagcgcattcagcaggcgctgggagccattggcgcactgg

SEQ ID NO: 193 - DNA, 613 bp, Artificial Sequence
  Synthetic polynucleotide
  misc_feature (1)..(613): delta-nifL::PinfC
atgaccctgaatatgatgctagaagcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatga

SEQ ID NO: 194 - DNA, 1613 bp, Artificial Sequence
  Synthetic polynucleotide
  misc_feature (1)..(1613): delta-nifL::PinfC with 500bp flank
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctagaagcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 195 - DNA, 1155 bp, Artificial Sequence
  Synthetic polynucleotide
  misc_feature (1)..(1155): glnE-delta-AR-2 36bp deletion
atggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaa

SEQ ID NO: 196 - DNA, 2155 bp, Artificial Sequence
  Synthetic polynucleotide
  misc_feature (1)..(2155): glnE-delta-AR-2 36bp deletion
cgtaaggcgaccacccagctccgcgcgttgctgaacgacgctgaagccgttctgctggccgcggacaccgccgacgaggcgttattccgcaccgaggtcgtcggcgccaaactggccctgactgaatggctggtccagcgcggctggcgtccgttcctcaacgaggcaggagagaaaaaaatagccggatcgttcaaacggtttgccgatattaacctctcgcgggtggcggccgagctgcgcagcgccgtgcagcatctggcggttgaagatgccgccgaccagttgccgaagctgtcccgcgacatcgacagcgtccagctgctggcgggcgcctatggcgacgccgtcgcgccgtggctggagaactggcaggagcttcaccgtgcaatagcacatgacgatcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctgcatatcgcggcggcggatatcgctggtaccctgccggtgatgaaggtcagcgatcacttaacctggcttgccgaagcgatcctcgacgcggtggtgcagcaggcatgggggcagatggtcgctcgctacggccagccgacccacctgcacgatcgccagggtcgcggcttcgccgtcgtcggctacggtaagcttggcggctgggagctgggctacagctccgatctcgatctggtgttcctccatgactgcccggcggaggtgatgaccgacggcgagcgggagattgacggccgtcagttctacctgcggctggcccagcggatcatgcacctgttcagcacccgcacctcgtccggtattctctacgaagtggacgcccggctgcgtccttctggcgcggcggggatgctggtcaccaccgccgacgcgtttgctgactatcagcagaacgaagcctggacgtgggaacatcaggcgctggtgcgcgcccgcgtggtctatggcgacccggcgctgcaggcgcgctttgacgccattcgtcgcgatatcctgaccaccccgcgggaggggatgaccctgcagaccgaggttcgcgagatgcgcgagaagatgcgcgcccaccttggcaacaaacatcccgatcgttttgatatcaaagccgatgccggcgggatcaccgatattgaatttattactcagtatctggtcctacgctatgccagtgacaagccgaagctgacccgctggtctgacaacgtgcgtattcttgagctgctggcgcagaacgacatcatggacgaggaggaggcgcgcgccttaacgcatgcgtacaccaccttgcgtgatgcgctccatcacctggccctgcaggagcagccgggacacgtggcgccagaggccttcagccgggagcgtcagcaggtcagcgccagctggcagaagtggctgatggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacatcgcctccctgggggcaacgtcgcgcctggtgggattgaccgggattgatgacgctgcccgcgcgctgagccaggcgctggccaatgtgaatgtgaagtgcgacttcgtctccgtcccgactcacccgaccatcaccaagctgcgggtgctgtcgcgcaatcagcagctgatccgcctcgactttgaagagggcttctccggcgtggatccgcagccgatgcatgagcgcattcagcaggcgctgggagccattggcgcactgg

SEQ ID NO: 197 - DNA, 412 bp, Artificial Sequence
  Synthetic polynucleotide
  misc_feature (1)..(412): delta-nifL::Prm8.2
atgaccctgaatatgatgctcgacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatga

SEQ ID NO: 198 - DNA, 1389 bp, Artificial Sequence
  Synthetic polynucleotide
  misc_feature (1)..(1389): delta-nifL::Prm8.2 with 500bp flank
cccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcattagcgcgaaatgatttttcacaagcgctggcaatccgacccgatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 199 - DNA, 1155 bp, Artificial Sequence; identical to SEQ ID NO: 195
  Synthetic polynucleotide
  misc_feature (1)..(1155): glnE-delta-AR-2 36bp deletion

SEQ ID NO: 200 - DNA, 2155 bp, Artificial Sequence; identical to SEQ ID NO: 196
  Synthetic polynucleotide
  misc_feature (1)..(2155): glnE-delta-AR-2 36bp deletion

SEQ ID NO: 201 - DNA, 413 bp, Artificial Sequence
  Synthetic polynucleotide
  misc_feature (1)..(413): delta-nifL::Prm6.2
atgaccctgaatatgatgctcgagctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatga

SEQ ID NO: 202 - DNA, 1413 bp, Artificial Sequence
  Synthetic polynucleotide
  misc_feature (1)..(1413): delta-nifL::Prm6.2 with 500bp flank
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgagctaaagttctcggctaatcgctgataacatttgacgcaatgcgcaataaaagggcatcatttgatgccctttttgcacgctttcataccagaacctggctcatcagtgattttttttgtcataatcattgctgagacaggctctgaagagggcgtttatacaccaaaccattcgagcggtagcgcgacggcaagtcagcgttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 203 - DNA, 513 bp, Artificial Sequence
  Synthetic polynucleotide
  misc_feature (1)..(513): delta-nifL::Prm1.2
atgaccctgaatatgatgctcgagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatga

SEQ ID NO: 204 - DNA, 1513 bp, Artificial Sequence
  Synthetic polynucleotide
  misc_feature (1)..(1513): delta-nifL::Prm1.2 with 500bp flank
ggccgtcgcccagcgtcggcgtccccaacagcagggccgggtaggccagcaggtccgccagcgtggcgcggttaatattgaccggggcggcggcggcctcccccagctgcttgtggatcattttcgcgatcttgcgggttttaccggtatcggtaccaaagaaaatgccaatgttcgccatagtacgctcctgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtc

SEQ ID NO: 205 - DNA, 1155 bp, Artificial Sequence; identical to SEQ ID NO: 195
  Synthetic polynucleotide
  misc_feature (1)..(1155): glnE-delta-AR-2 36bp deletion

SEQ ID NO: 206 - DNA, 2155 bp, Artificial Sequence; identical to SEQ ID NO: 196
  Synthetic polynucleotide
  misc_feature (1)..(2155): glnE-delta-AR-2 36bp deletion

SEQ ID NO: 207 - DNA, 613 bp, Artificial Sequence; identical to SEQ ID NO: 193
  Synthetic polynucleotide
  misc_feature (1)..(613): delta-nifL::PinfC

SEQ ID NO: 208 - DNA, 1613 bp, Artificial Sequence; identical to SEQ ID NO: 194
  Synthetic polynucleotide
  misc_feature (1)..(1613): delta-nifL::PinfC with 500bp flank

SEQ ID NO: 209 - DNA, 1191 bp, Artificial Sequence; identical to SEQ ID NO: 191
  Synthetic polynucleotide
  misc_feature (1)..(1191): glnE-delta-AR-2

SEQ ID NO: 210 - DNA, 2191 bp, Artificial Sequence; identical to SEQ ID NO: 192
  Synthetic polynucleotide
  misc_feature (1)..(2191): glnE-delta-AR-2 with 500bp flank

SEQ ID NO: 211 - DNA, 1188 bp, Artificial Sequence
  Synthetic polynucleotide
  misc_feature (1)..(1188): glnE-delta-AR-2
atggcgctcaaacagttaatccgtctgtgtgccgcctcgccgatggtcgcgacacaacttgcacgtcatcctttattgctcgatgaactgctcgacccgcgcacgctttaccagccgattgagccgggcgcttaccgcgacgaactgcgtcagtatctgatgcgggtgccaacagaagacgaagaacagcagcttgaagccgtgcgccagttcaaacaggcccagcatttgcgtatcgcagccggggatatttccggggcattgccggtgatgaaagtcagtgaccatttaacctaccttgccgaggccattctcgatgtcgtggtgcagcatgcgtgggaacaaatggtcgtaaaatacgggcagcccgcgcatcttcagcaccgtgaggggcgcggttttgccgtggtcggttacgggaaactcggtggctgggagctgggttatagctcagatctggatctggtcttcctgctcgattgcgcgccggaggtgatgacggacggcgaacgcagcatcgacggacgtcagttttatcttcggctggcgcagcgcattatgcacttattcagcacccggacatcgtcaggcattctttacgaggttgatccgcgtctgcgaccttccggcgcatccggcatgctggtcagtaccattgaagcgtttgcagattatcaggccaatgaagcctggacgtgggagcatcaggcgctggttcgcgcgcgcgtggtttacggggatccgcaactgacacagcaatttaacgccacgcgtcgcgacattctttgccgccagcgcgatggcgacggcctgcgtaaggaggtccgtgaaatgcgcgagaaaatgtatgcccatctggggagtaaaaaagcccacgagtttgatctgaaagccgatccgggtggcatcacggatattgaattcattgcacaatacctggttctgcgtttcgcgcatgatgagccgaagctgacgcgctggtctgataacgtgcggatttttgaactgatggcacgatatgacatcatgccggaagaggaagcgcgccatctgacgcaggcttatgtgacgctgcgcgatgaaattcatcatctggcgttgcaggaacacagcgggaaagtggccgcggacagctttgctactgagcgcgcgcagatccgtgccagctgggcaaagtggctcggctga

SEQ ID NO: 212 - DNA, 2188 bp, Artificial Sequence
  Synthetic polynucleotide
  misc_feature (1)..(2188): glnE-delta-AR-2 with 500bp flank
cggtactggaacagaaatcggcggatgcgcaggaaatttgttatgacacggcctgtctgaagtgcaagttagtgcttacttcctggctggcaacctcaggctggacgccgtttattgatgataaatctgcgaagaaactggacgcttccttcaaacgttttgctgacatcatgctcggtcgtaccgcagcggatctgaaagaagcctttgcgcagccactgacggaagaaggttatcgcgatcagctggcgcgcctgaaacgccagatcattaccttccatttgcttgccggtgcttaccctgaaaaagacgtcgatgcgtatattgccggctgggtggacctgcaacaggccatcgttcagcagcaacacgcctgggaggattcggcccgttctcacgcggtgatgatggatgctttctggttaaacgggcaacctcgttaactgactgactagcctgggcaaactgcccgggcttttttttgcaaggaatctgatttcatggcgctcaaacagttaatccgtctgtgtgccgcctcgccgatggtcgcgacacaacttgcacgtcatcctttattgctcgatgaactgctcgacccgcgcacgctttaccagccgattgagccgggcgcttaccgcgacgaactgcgtcagtatctgatgcgggtgccaacagaagacgaagaacagcagcttgaagccgtgcgccagttcaaacaggcccagcatttgcgtatcgcagccggggatatttccggggcattgccggtgatgaaagtcagtgaccatttaacctaccttgccgaggccattctcgatgtcgtggtgcagcatgcgtgggaacaaatggtcgtaaaatacgggcagcccgcgcatcttcagcaccgtgaggggcgcggttttgccgtggtcggttacgggaaactcggtggctgggagctgggttatagctcagatctggatctggtcttcctgctcgattgcgcgccggaggtgatgacggacggcgaacgcagcatcgacggacgtcagttttatcttcggctggcgcagcgcattatgcacttattcagcacccggacatcgtcaggcattctttacgaggttgatccgcgtctgcgaccttccggcgcatccggcatgctggtcagtaccattgaagcgtttgcagattatcaggccaatgaagcctggacgtgggagcatcaggcgctggttcgcgcgcgcgtggtttacggggatccgcaactgacacagcaatttaacgccacgcgtcgcgacattctttgccgccagcgcgatggcgacggcctgcgtaaggaggtccgtgaaatgcgcgagaaaatgtatgcccatctggggagtaaaaaagcccacgagtttgatctgaaagccgatccgggtggcatcacggatattgaattcattgcacaatacctggttctgcgtttcgcgcatgatgagccgaagctgacgcgctggtctgataacgtgcggatttttgaactgatggcacgatatgacatcatgccggaagaggaagcgcgccatctgacgcaggcttatgtgacgctgcgcgatgaaattcatcatctggcgttgcaggaacacagcgggaaagtggccgcggacagctttgctactgagcgcgcgcagatccgtgccagctgggcaaagtggctcggctgagggtttttattcggctaacaggcgcttgtgatattatccggcgcattgtatttacccgatttgatttatctgttttggagtcttgggatgaaagtgactttgcctgattttcaccgcgcaggtgtgctggttgtcggtgacgtaatgttagaccgttactggtatggcccgaccaatcgtatttctccggaagctccggtgccggtggtgaaggtcagtaccattgaagagcggcctggcggtgcagctaacgtggcgatgaacatttcatctctgggcgcctcttcctgtctgatcggcctgaccggcgtagacgacgctgcgcgtgccctcagtgagcgtctggcagaagtgaaagttaactgcgatttcgtcgcactatccacacatcctaccatcaccaaactgcgaattttgtcccgtaaccagcaactgatccgcctcgactttgaggaaggttttgaaggcgttgatctcgagccgatgctgaccaaaataga

SEQ ID NO: 213 - DNA, 635 bp, Artificial Sequence
  Synthetic polynucleotide
  misc_feature (1)..(635): delta-nifL::Prm6.1
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggaattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccctccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 214 - DNA, 1635 bp, Artificial Sequence
  Synthetic polynucleotide
  misc_feature (1)..(1635): delta-nifL::Prm6.1 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggaattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccctccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 215 - DNA, 635 bp, Artificial Sequence; identical to SEQ ID NO: 213
  Synthetic polynucleotide
  misc_feature (1)..(635): delta-nifL::Prm6.1

SEQ ID NO: 216 - DNA, 1635 bp, Artificial Sequence; identical to SEQ ID NO: 214
  Synthetic polynucleotide
  misc_feature (1)..(1635): delta-nifL::Prm6.1 with 500bp flank

SEQ ID NO: 217 - DNA, 786 bp, Artificial Sequence
  Synthetic polynucleotide
  misc_feature (1)..(786): delta-nifL::Prm7.1
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttataccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 218 - DNA, 1786 bp, Artificial Sequence
  Synthetic polynucleotide
  misc_feature (1)..(1786): delta-nifL::Prm7.1 with 500bp flank
gtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttataccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtcg

SEQ ID NO: 219 - DNA, 993 bp, Artificial Sequence
  Synthetic polynucleotide
  misc_feature (1)..(993): delta-nifL::Prm1.2
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 220 - DNA, 1993 bp, Artificial Sequence
  Synthetic polynucleotide
  misc_feature (1)..(1993): delta-nifL::Prm1.2 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 221 - DNA, 993 bp, Artificial Sequence; identical to SEQ ID NO: 219
  Synthetic polynucleotide
  misc_feature (1)..(993): delta-nifL::Prm1.2

SEQ ID NO: 222 - DNA, 1993 bp, Artificial Sequence; identical to SEQ ID NO: 220
  Synthetic polynucleotide
  misc_feature (1)..(1993): delta-nifL::Prm1.2 with 500bp flank

SEQ ID NO: 223 - DNA, 1188 bp, Artificial Sequence; identical to SEQ ID NO: 211
  Synthetic polynucleotide
  misc_feature (1)..(1188): glnE-delta-AR-2

SEQ ID NO: 224 - DNA, 2188 bp, Artificial Sequence; identical to SEQ ID NO: 212
  Synthetic polynucleotide
  misc_feature (1)..(2188): glnE-delta-AR-2 with 500bp flank

SEQ ID NO: 225 - DNA, 663 bp, Artificial Sequence
  Synthetic polynucleotide
  misc_feature (1)..(663): delta-nifL::Prm3.1
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 226 - DNA, 1663 bp, Artificial Sequence
  Synthetic polynucleotide
  misc_feature (1)..(1663): delta-nifL::Prm3.1 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 227 - DNA, 1188 bp, Artificial Sequence; identical to SEQ ID NO: 211
  Synthetic polynucleotide
  misc_feature (1)..(1188): glnE-delta-AR-2

SEQ ID NO: 228 - DNA, 2188 bp, Artificial Sequence; identical to SEQ ID NO: 212
  Synthetic polynucleotide
  misc_feature (1)..(2188): glnE-delta-AR-2 with 500bp flank

SEQ ID NO: 229 - DNA, 613 bp, Artificial Sequence
  Synthetic polynucleotide
  misc_feature (1)..(613): delta-nifL::PinfC
atgagcatcacggcgttatcagctgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatga

SEQ ID NO: 230 - DNA, 1613 bp, Artificial Sequence
  Synthetic polynucleotide
  misc_feature (1)..(1613): delta-nifL::PinfC with 500bp flank
tgtttcgtctcgaagccgggcaactgagcagccccgttgaaaccgaactgggctggcatctgttgttgtgcgaacaaattcgcctgccgcaacccttgccgaaagccgaggccttaacgcgggtgcgtcagcaactgattgcccggcaacagaatcattatcagcgccagtggctgcaacaactgatcaacgcctgagcctgttctccttcttgttggtgcagacgggttaatgcccgttttgcacgaaaaatgcacataaactgccttcgctgccttataacagcgcatggaaatcctgcctcctgccttgtgccacgccgcgctttgcctggtttgtggtaaaaactggcccgctttgcatcctgatgtttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagctgaatatcactgactcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtactcgtcgcggcaaagacttaggaagcatggatgttagcgaagtcgttgacaaactgctggcggaaatccgcagcagaagtcatcatcaactggaggaataaagtattaaaggcggaaaacgagttcaaccggcgcgtcctaatcgcattaacaaagagattcgcgcgcaagaagttcgcctcaccggcgtcgatggcgagcagattggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaataccgcgcgcgcactggcggcgatcctcgaagtgcttcacgatcatgcatttatgcaatacggcatggtgtgtctgttcgataaagaacgcaatgcactgtttgtggaatccctgcatggcatcgacggcgaaaggaaaaaagaaacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgctgattggtgtgccgatccccggtgcggataatcagcctgcgggtgtgctggtggcacagccgatggcgttgcacgaagaccggctggctgccagtacgcggtttttagaaatggtc

SEQ ID NO: 231 - DNA, 426 bp, Artificial Sequence; identical to SEQ ID NO: 38
  Synthetic polynucleotide
  misc_feature (1)..(426): delta-nifL::Prm5

SEQ ID NO: 232 - DNA, 1426 bp, Artificial Sequence
  Synthetic polynucleotide
  misc_feature (1)..(1426): delta-nifL::Prm5 with 500bp flank
accggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtc

SEQ ID NO: 233 - DNA, 461 bp, Artificial Sequence; identical to SEQ ID NO: 41
  Synthetic polynucleotide
  misc_feature (1)..(461): delta-nifL::Prm1

SEQ ID NO: 234 - DNA, 1461 bp, Artificial Sequence
  Synthetic polynucleotide
  misc_feature (1)..(1461): delta-nifL::Prm1 with 500bp flank
accggatacgagagaaaagtgtctacatcggttcggttgatattgaccggcgcatccgccagcccgcccagtttctggtggatctgtttggcgattttgcgggtcttgccggtgtcggtgccgaaaaaaataccaatatttgccataacacacgctcctgttgaaaaagagatcccgccgggaaatgcggtgaacgtgtctgatattgcgaagagtgtgccagttttggtcgcgggcaaaacctgcaccagtttggttattaatgcaccagtctggcgctttttttcgccgagtttctcctcgctaatgcccgccaggcgcggctttggcgctgatagcgcgctgaataccgatctggatcaaggttttgtcgggttatcagccaaaaggtgcactctttgcatggttatacgtgcctgacatgttgtccgggcgacaaacggcctggtggcacaaattgtcagaactacgacacgactaactgaccgcaggagtgtgcgatgaccctgaatatgatgatggatgccggccgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatgacccagcgaaccgagtcgggtaataccgtctggcgcttcgatttgtcccagcagttcactgcgatgcagcgcataagcgtggtactcagccgggcgaccgaggtcgatcagacgctccagcaagtgctgtgcgtattgcacaatgacgcctttttgcagcacggcatgatctgtctgtacgacagccagcaggcgattttgaatattgaagcgttgcaggaagccgatcagcagttaatccccggcagctcgcaaatccgctatcgtccgggcgaagggctggtcgggacggtgctttcgcagggccaatcattagtgctggcgcgcgttgctgacgatcagcgctttcttgaccggctcgggttgtatgattacaacctgccgtttatcgccgtgccgctgatagggccagatgcgcagactttcggtgtgctgacggcacaacccatggcgcgttacgaagagcgattacccgcctgcacccgctttctggaaacggtc

SEQ ID NO: 235 - DNA, 461 bp, Artificial Sequence; identical to SEQ ID NO: 41
  Synthetic polynucleotide
  misc_feature (1)..(461): delta-nifL::Prm1

SEQ ID NO: 236 - DNA, 1461 bp, Artificial Sequence; identical to SEQ ID NO: 234
  Synthetic polynucleotide
  misc_feature (1)..(1461): delta-nifL::Prm1 with 500bp flank

SEQ ID NO: 237 - DNA, 1188 bp, Artificial Sequence
  Synthetic polynucleotide
  misc_feature (1)..(1188): glnE-delta-AR-2
atggcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaa

SEQ ID NO: 238 - DNA, 2206 bp, Artificial Sequence
  Synthetic polynucleotide
  misc_feature (1)..(2206): glnE-delta-AR-2 with 500bp flank
gcgcaaagcgagtgctcacttacgtgatctgttgacacaatctgaagcgaccataacttctgccgtttcagcgaatacggcggtgtggagcgcacaatcagccctggcgaagctggtgctcaccgagtggctagtgacgcagggctggcgaaccttccttgatgaaaaagcgcaggccaaattcgccgactcctttaaacgctttgctgacatccatctgtcacgcagcgccgccgagctgaaaaaagcctttgcccaaccgctgggcgacagctatcgcgaccagttgccgcgcctggcgcgtgatatcgactgcgcgttactgctggccgggcattacgatcgcgcgcgcgccgtggaatggctggaaaactggcaggggcttcagcacgccattgaaacgcgccagagagtcgaaatcgaacatttccgtaataccgcgattacccaggagccgttctggttgcacagcggaaaacgttaacgaaaggatatttcgcatggcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaagtgtggtatcatcgcgcgcaaattttgtatctctcaggagacaggaatgaaagtgacgctgccagagtttaagcaagccggtgtaatggtggtgggtgatgtgatgctggatcgttactggtatggcccaaccagccgtatctctccggaagcgccagtcccggttgttaaagtcgataccattgaagagcgtcctggcggcgcggcaaacgtggcgatgaatatcgcctcactgggcgccacggcgcgtctggttggcctgactggcattgacgatgcggcgcgcgcgctgagcaaagcgctggccgatgttaacgttaaatgtgacttcgtttctgttccgacgcatcccaccatcactaagctgcgcgtgctgtcgcgtaaccagcagctgattcgcctggactttgaagagggttttgaaggagtcgatccgcaaccgatgcatgaacgcatcagccaggcgcttggtaatattggcgcgctggtgctgtcggatt

SEQ ID NO: 239 - DNA, 1563 bp, Artificial Sequence; identical to SEQ ID NO: 61
  Synthetic polynucleotide
  misc_feature (1)..(1563): glnE-delta-AR-1

SEQ ID NO: 240 - DNA, 461 bp, Artificial Sequence; identical to SEQ ID NO: 41
  Synthetic polynucleotide
  misc_feature (1)..(461): delta-nifL::Prm1

SEQ ID NO: 241 - DNA, 1461 bp, Artificial Sequence; identical to SEQ ID NO: 234
  Synthetic polynucleotide
  misc_feature (1)..(1461): delta-nifL::Prm1 with 500bp flank

SEQ ID NO: 242 - DNA, 2563 bp, Artificial Sequence
  Synthetic polynucleotide
  misc_feature (1)..(2563): glnE-delta-AR-1 with 500bp flank
gcgcaaagcgagtgctcacttacgtgatctgttgacacaatctgaagcgaccataacttctgccgtttcagcgaatacggcggtgtggagcgcacaatcagccctggcgaagctggtgctcaccgagtggctagtgacgcagggctggcgaaccttccttgatgaaaaagcgcaggccaaattcgccgactcctttaaacgctttgctgacatccatctgtcacgcagcgccgccgagctgaaaaaagcctttgcccaaccgctgggcgacagctatcgcgaccagttgccgcgcctggcgcgtgatatcgactgcgcgttactgctggccgggcattacgatcgcgcgcgcgccgtggaatggctggaaaactggcaggggcttcagcacgccattgaaacgcgccagagagtcgaaatcgaacatttccgtaataccgcgattacccaggagccgttctggttgcacagcggaaaacgttaacgaaaggatatttcgcatgtttaacgatctgattggcgatgatgaaacggattcgccggaagatgcgctttctgagagctggcgcgaattgtggcaggatgcgttgcaggaggaggattccacgcccgtgctggcgcatctctcagaggacgatcgccgccgcgtggtggcgctgattgccgattttcgcaaagagttggataaacgcaccattggcccgcgagggcggcaggtactcgatcacttaatgccgcatctgctcagcgatgtatgctcgcgcgacgatgcgccagtaccgctgtcacgcctgacgccgctgctcaccggaattattacccgcaccacttaccttgagctgctaagtgaatttcccggcgcactgaaacacctcatttccctgtgtgccgcgtcgccgatggttgccagtcagctggcgcgctacccgatcctgcttgatgaattgctcgacccgaatacgctctatcaaccgacggcgatgaatgcctatcgcgatgagctgcgccaatacctgctgcgcgtgccggaagatgatgaagagcaacagcttgaggcgctgcggcagtttaagcaggcgcagttgctgcgcgtggcggcggcggatattgccggtacgttgccagtaatgaaagtgagcgatcacttaacctggctggcggaagcgattattgatgcggtggtgcagcaagcctgggggcagatggtggcgcgttatggccagccaacgcatctgcacgatcgcgaagggcgcggttttgcggtggtcggttatggcaagctgggcggctgggagctgggttacagctccgatctggatctggtattcctgcacgactgcccgatggatgtgatgaccgatggcgagcgtgaaatcgatggtcgccagttctatttgcgtctcgcgcagcgcgtgatgcacctgtttagcacgcgcacgtcgtccggcatcctttatgaagttgatgcgcgtctgcgtccatctggcgctgcggggatgctggtcactactacggaatcgttcgccgattaccagcaaaacgaagcctggacgtgggaacatcaggcgctggcccgtgcgcgcgtggtgtacggcgatccgcaactgaccgccgaatttgacgccattcgccgcgatattctgatgacgcctcgcgacggcgcaacgctgcaaaccgacgtgcgagaaatgcgcgagaaaatgcgtgcccatcttggcaacaagcataaagaccgcttcgatctgaaagccgatgaaggcggtatcaccgacatcgagtttatcgcccaatatctggtgctgcgctttgcccatgacaagccgaaactgacgcgctggtcggataatgtgcgcattctcgaagggctggcgcaaaacggcatcatggaggagcaggaagcgcaggcattgacgctggcgtacaccacattgcgtgatgagctgcaccacctggcgctgcaagagttgccgggacatgtggcgctctcctgttttgtcgccgagcgtgcgcttattaaaaccagctgggacaagtggctggtggaaccgtgcgccccggcgtaagtgtggtatcatcgcgcgcaaattttgtatctctcaggagacaggaatgaaagtgacgctgccagagtttaagcaagccggtgtaatggtggtgggtgatgtgatgctggatcgttactggtatggcccaaccagccgtatctctccggaagcgccagtcccggttgttaaagtcgataccattgaagagcgtcctggcggcgcggcaaacgtggcgatgaatatcgcctcactgggcgccacggcgcgtctggttggcctgactggcattgacgatgcggcgcgcgcgctgagcaaagcgctggccgatgttaacgttaaatgtgacttcgtttctgttccgacgcatcccaccatcactaagctgcgcgtgctgtcgcgtaaccagcagctgattcgcctggactttgaagagggttttgaaggagtcgatccgcaaccgatgcatgaacgcatcagccaggcgcttggtaatattggcgcgctggtgctgtcggatt

SEQ ID NO: 243 - DNA, 1563 bp, Artificial Sequence; identical to SEQ ID NO: 61
  Synthetic polynucleotide
  misc_feature (1)..(1563): glnE-delta-AR-1

SEQ ID NO: 244 - DNA, 2563 bp, Artificial Sequence; identical to SEQ ID NO: 242
  Synthetic polynucleotide
  misc_feature (1)..(2563): glnE-delta-AR-1 with 500bp flank

SEQ ID NO: 245 - DNA, 426 bp, Artificial Sequence; identical to SEQ ID NO: 38
  Synthetic polynucleotide
  misc_feature (1)..(426): delta-nifL::Prm5

SEQ ID NO: 246 - DNA, 1426 bp, Artificial Sequence; identical to SEQ ID NO: 232
  Synthetic polynucleotide
  misc_feature (1)..(1426): delta-nifL::Prm5 with 500bp flank

SEQ ID NO: 247 - DNA, 461 bp, Artificial Sequence; identical to SEQ ID NO: 41
  Synthetic polynucleotide
  misc_feature (1)..(461): delta-nifL::Prm1

SEQ ID NO: 248 - DNA, 1461 bp, Artificial Sequence; identical to SEQ ID NO: 234
  Synthetic polynucleotide
  misc_feature (1)..(1461): delta-nifL::Prm1 with 500bp flank

SEQ ID NO: 249 - DNA, 1188 bp, Artificial Sequence; identical to SEQ ID NO: 237
  Synthetic polynucleotide
  misc_feature (1)..(1188): glnE-delta-AR-2

SEQ ID NO: 250 - DNA, 2206 bp, Artificial Sequence; identical to SEQ ID NO: 238
  Synthetic polynucleotide
  misc_feature (1)..(2206): glnE-delta-AR-2 with 500bp flank

SEQ ID NO: 251 - DNA, 199 bp, Artificial Sequence
  Synthetic polynucleotide
  misc_feature (1)..(199): delta-amtB
tttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctga

SEQ ID NO: 252 - DNA, 1199 bp, Artificial Sequence
  Synthetic polynucleotide
  misc_feature (1)..(1199): delta-amtB with 500bp flank
tttcctttctgactctgcccgtccgggcgcactaacggcctgaaatactccctcttttcattcctggcacaacgattgcaatgtctgttgcgtgttagctgcggccattatcgaattcgactggagggggatctatgaagctggttaccgtggtgattaagccattcaaacttgaagacgtgcgtgaagcgctttcttctattggtattcaagggttgaccgtaactgaagtgaaaggctttggccgtcagaagggtcacgctgagctgtaccgcggtgcggaatatagcgttaatttcctgccgaaagtgaaaattgatgtggcgatcgctgacgatcaactcgatgaagtaatcgatgtgatcagcaaagcggcctacaccggaaaaattggcgacggcaaaattttcgttgctgagctgcaacgcgtcattcgtattcgtaccggcgaagccgacgaagcggcactgtaatacaagacacacagtgatggggatcggtttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctgattgcgttgagttatctcctgagcataaaaaagcctccattcggaggcttttctttttttaagtttaaagcgcggttagttgcgattgcgcatgacgccttcctgcacgctggacgcgaccagcacaccctcttgcgtatagaactcgccgcgcacaaaaccgcgagcgctggaggctgacgtgctttccacactgtagagcagccattcgttcatattaaacgggcgatggaaccacatggagtggtcaatggtggcaacctgcataccgcgctcaaggaagcccacgccgtgcggctgaagtgcaaccggcaggaagttaaagtctgaggcatatccaagcagatattgatgtacgcgaaaatcgtccggcaccgtgccgtttgcgcggatccatacctggcgggtgggatcggcaacgtggcctttcagcgggttatgaaactcaaccgggcggatctccagtggtttatcactaagaaacttctctttggcctgcgg

SEQ ID NO: 253 - DNA, 1563 bp, Artificial Sequence; identical to SEQ ID NO: 61
  Synthetic polynucleotide
  misc_feature (1)..(1563): glnE-delta-AR-1

SEQ ID NO: 254 - DNA, 2563 bp, Artificial Sequence; identical to SEQ ID NO: 242
  Synthetic polynucleotide
  misc_feature (1)..(2563): glnE-delta-AR-1 with 500bp flank

SEQ ID NO: 255 - DNA, 461 bp, Artificial Sequence; identical to SEQ ID NO: 41
  Synthetic polynucleotide
  misc_feature (1)..(461): delta-nifL::Prm1

SEQ ID NO: 256 - DNA, 1461 bp, Artificial Sequence; identical to SEQ ID NO: 234
  Synthetic polynucleotide
  misc_feature (1)..(1461): delta-nifL::Prm1 with 500bp flank

SEQ ID NO: 257 - DNA, 199 bp, Artificial Sequence; identical to SEQ ID NO: 251
  Synthetic polynucleotide
  misc_feature (1)..(199): delta-amtB

SEQ ID NO: 258 - DNA, 1199 bp, Artificial Sequence; identical to SEQ ID NO: 252
  Synthetic polynucleotide
  misc_feature (1)..(258): delta-amtB with 500bp flank

SEQ ID NO: 259 - DNA, 607 bp, Artificial Sequence
  Synthetic polynucleotide
  misc_feature (1)..(607): delta-nifL::PinfC
atgacctttaatatgatgcctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatga

SEQ ID NO: 260 - DNA, 1607 bp, Artificial Sequence
  Synthetic polynucleotide
  misc_feature (1)..(1607): delta-nifL::PinfC with 500bp flank
ggtacgacaaaaacgtctccagcgacgtgcggttaatattgactggcgcatccgccacatcccccagtttttgctggatcagtttggcgattttgcgggtttttcccgtgtcactgccaaaaaaaataccaatgttagccatgtcgcgctcctgttgagaaagaataaggccgcctgcaaacggcggatatcccttctcctgttgcgaaggctgtgccaggtttttttaaggccttctgtgcactgaaatgggtgaaaaaatgactcttttttgtgcaggcaccgtcctctctccgctatccagacctgctttgaaggcctctgagggccaaatcagggccaaaacacgaatcaggatcaatgtttcggcgcgttacctgttcgaaaggtgcactctttgcatggttaatcacacccaatcagggctgcggatgtcgggcgtttcacaacacaaaatgttgtaaatgcgacacagccgggcctgaaaccaggagcgtgtgatgacctttaatatgatgcctggggtcactggagcgctttatcggcatcctgaccgaagaatttgccggtttcttcccgacctggctggcccctgttcaggttgtggtgatgaatatcactgattctcaagctgaatatgtcaacgaattgacccgtaaattgcaaaatgcgggcattcgtgtaaaagcggacttgagaaacgagaagattggctttaaaatccgcgagcacactttacgtcgtgtcccttatatgttggtctgtggtgataaagaggtggaagcaggcaaagtggccgttcgcacccgccgcggtaaagacctgggcagcctggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatgacccagcgacccgagtcgggcaccaccgtctggcgttttgatctctcacagcaatttaccgccatgcagcgcatcagcgtggtgttgagtcgcgcaaccgagataagccagacgctgcaggaggtgctgtgtgttctgcataatgacgcatttatgcaacacggcatgctgtgtctgtatgacaaccagcaggaaattctgagtattgaagccttgcaggaggcagaccaacatctgatccccggcagctcgcaaattcgctatcgccctggcgaagggctggtaggagccgtactgtcccagggacaatctcttgtgctgccgcgtgtcgccgacgatcaacgctttctcgacaggcttggcatctatgattacaacctgccgtttatcgccgtccccttaatggggccaggcgcgcagacgattggcgtgctcgccgcgcagccgatggcgcgtctggaggagcggcttccttcctgtacgcgctttctggaaaccgtc

SEQ ID NO: 261 - DNA, 1536 bp, Kosakonia sacchari; identical to SEQ ID NO: 62
  gene (1)..(1536): 16S-1

SEQ ID NO: 262 - DNA, 1537 bp, Kosakonia sacchari; identical to SEQ ID NO: 63
  gene (1)..(1537): 16S-2
  misc_feature (450)..(450): n is a, c, t, g, unknown or other
  misc_feature (452)..(452): n is a, c, t, g, unknown or other
  misc_feature (455)..(455): n is a, c, t, g, unknown or other
  misc_feature (473)..(473): n is a, c, t, g, unknown or other

SEQ ID NO: 263 - DNA, 882 bp, Kosakonia sacchari; identical to SEQ ID NO: 65
  gene (1)..(882): nifH

SEQ ID NO: 264 - DNA, 1449 bp, Kosakonia sacchari; identical to SEQ ID NO: 66
  gene (1)..(1449): nifD2

SEQ ID NO: 265 - DNA, 1563 bp, Kosakonia sacchari; identical to SEQ ID NO: 67
  gene (1)..(1563): nifK2

SEQ ID NO: 266 - DNA, 1488 bp, Kosakonia sacchari; identical to SEQ ID NO: 68
  gene (1)..(1488): nifL

SEQ ID NO: 267 - DNA, 1575 bp, Kosakonia sacchari; identical to SEQ ID NO: 69
  gene (1)..(1575): nifA

SEQ ID NO: 268 - DNA, 2850 bp, Kosakonia sacchari; identical to SEQ ID NO: 79
  gene (1)..(2850): glnE

SEQ ID NO: 269 - DNA, 1536 bp, Kosakonia sacchari
  gene (1)..(1536): 16S-3
  misc_feature (766)..(776): n is a, c, t, g, unknown or other
  misc_feature (905)..(905): n is a, c, t, g, unknown or other
attgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagtaaggttaataaccttgctcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagnnnnnnnnnnnaacaggattagataccctggtagtccatgccgtaaacgatgtctactagccgttggggcctttgaggctttagtggcgcagctaacgcgataagtagaccgcctggggagtacggtcgcaagactaaanctcaaatgaattgacgggggcccgcacaagcggtggagcatgtggtttaattcgatgcaacgcgaagaaccttacctggccttgacatagtaagaattttccagagatggattggtgccttcgggaacttacatacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctccttt

SEQ ID NO: 270 - DNA, 882 bp, Kosakonia sacchari; identical to SEQ ID NO: 65
  gene (1)..(882): nifD1

SEQ ID NO: 271 - DNA, 1386 bp, Kosakonia sacchari
  gene (1)..(1386): nifK1
atggccgaaattctgcgcagtaaaaaaccgctggcggtcagcccgataaaaagcggccagccgctgggggcgatcctcgcaagcctgggtgtcgaacagtgcataccgctggtacacggcgcacagggatgtagcgcgttcgcgaaggtgttctttattcaacattttcacgatccgatcccgctgcaatcgacggcgatggatccgacttccaccattatgggcgccgatgaaaacatttttaccgcgctcaatgtgctctgccagcgcaacgccgcgaaagccattgtgctgctcagcaccgggctttcagaagcccagggcagcgacatttcgcgggtggtgcgccagtttcgtgatgattttccccggcataaaggcgttgcgctgctcaccgtcaacacacccgatttctacggctcgctggaaaacggctacagcgccgtgctggaaagcatgattgaacagtgggtacccgcacagcccgccgccagcctgcgcaaccgccgtgtcaacctgctggtcagccatttactgacaccaggcgatatcgaactgttgcgcagttatgttgaagccttcggcctgcaaccggtgattgtgccggatctgtcgctgtcgctggacgggcatctggcagacggtgatttttcgcctgttacccaagggggaacatcgctgcgcatgattgaacagatggggcaaaacctggccacctttgtgattggcgcctcgctgggccgtgcggcggcgttactggcgcagcgcagccgtggcgaggtgatcgccctgccgcatctgatgacgcttgcagcctgcgacacgtttattcatcgactgaaaaccctctccgggcgcgatgtccccgcgtggattgagcgccagcgcggccaagttcaggatgcgatgatcgattgccatatgtggctgcagggtgcggctatcgccatggcagcagaaggcgatcacctggcggcatggtgcgatttcgcccgcagccagggcatgatccccggcccgattgtcgcaccggtcagccagccggggttgcaaaatctgccggttgaaaccgtggttatcggcgatctggaagatatgcaggatcggctttgcgcgacgcccgccgcgttactggtggccaattctcatgccgccgatctcgccacgcagtttgatttgtcacttatccgcgccgggttcccggtgtatgaccggctgggggaatttcgtcgcctgcgccaggggtacagcggcattcgtgacacgctgtttgagctggcgaatgtgatgcgcgagcgccatcacccgcttgcaacctaccgctcgccgctgcgccagcacgccgacgacaacgttacgcctggagatctgtatgccgcatgttaa

SEQ ID NO: 272 - DNA, 1287 bp, Kosakonia sacchari
  gene (1)..(1287): amtB
atgaaaaacacaacattaaaaacagcgcttgcttcgctggcgttactgcctggcctggcgatggcggctcccgctgtggcggataaagccgacaacggctttatgatgatttgcaccgcgctggtgctgtttatgaccattccgggcattgcgctgttctacggcggtttgatccgcggtaaaaacgtgctgtcgatgctgacgcaggttgccgtcaccttcgcactggtgtgcattctgtgggtggtgtatggctactcgctggcatttggcgagggcaacagcttcttcgggagttttaactgggcgatgttgaaaaacatcgaactgaaagccgtgatgggcagcatttatcagtatatccacgtggcgttccagggttccttcgcctgtatcaccgttggcctgattgtcggtgcactggctgagcgtattcgcttctctgcggtgctgatttttgtggtggtatggctgacgctttcttacgtgccgattgcacacatggtgtggggcggcggtctgctggcaacccacggtgcgctggatttcgcaggcggtacggttgttcacatcaacgctgcgattgcaggtctggtgggggcttacctgattggcaaacgcgtgggctttggcaaagaagcattcaaaccgcataacctgccgatggtcttcactggcaccgctatcctgtatgttggctggtttggtttcaacgccggctccgcaagctcggcgaacgaaattgctgcgctggccttcgtgaacactgtcgttgccactgctgccgctattctggcgtgggtatttggcgaatgggcaatgcgcggcaagccgtctctgctcggtgcctgttctggtgccatcgcgggtctggttggtatcacccccgcctgtggttatgtgggtgtcggcggtgcgctgattgtgggtctgattgccggtctggctgggctgtggggcgttactgcgctgaaacgtatgttgcgtgtcgatgacccgtgtgacgtattcggtgtgcacggcgtgtgcggcatcgtgggctgtatcctgacgggtatcttcgcctctacgtcgctgggtggtgtcggtttcgctgaaggtgtgaccatgggccatcaggtgctggtgcagctggaaagtgttgccatcactatcgtgtggtctggcgtggtggcctttattggttacaaactggcggacatgacggtaggcctgcgcgtaccggaagaacaagaacgtgaagggctggatgtaaacagccacggcgaaaacgcctataacgcctga

SEQ ID NO: 273 - DNA, 348 bp, Kosakonia sacchari
  gene (1)..(348): Prm1
cgtcctgtaataataaccggacaattcggactgattaaaaaagcgcccttgtggcgctttttttatattcccgcctccatttaaaataaaaaatccaatcggatttcactatttaaactggccattatctaagatgaatccgatggaagctcgctgttttaacacgcgttttttaaccttttattgaaagtcggtgcttctttgagcgaacgatcaaatttaagtggattcccatcaaaaaaatattctcaacctaaaaaagtttgtgtaatacttgtaacgctacatggagattaactcaatctagagggtattaataatgaatcgtactaaactggtactgggcgc

SEQ ID NO: 274 - DNA, 313 bp, Kosakonia sacchari
  gene (1)..(313): Prm5
ggacatcatcgcgacaaacaatattaataccggcaaccacaccggcaatttacgagactgcgcaggcatcctttctcccgtcaatttctgtcaaataaagtaaaagaggcagtctacttgaattacccccggctggttgagcgtttgttgaaaaaaagtaactgaaaaatccgtagaatagcgccactctgatggttaattaacctattcaattaagaattatctggatgaatgtgccattaaatgcgcagcataatggtgcgttgtgcgggaaaactgcttttttttgaaagggttggtcagtagcggaaac

SEQ ID NO: 275 - DNA, 1485 bp, Rahnella aquatilis; identical to SEQ ID NO: 103
  gene (1)..(1485): nifL

SEQ ID NO: 276 - DNA, 1575 bp, Rahnella aquatilis; identical to SEQ ID NO: 104
  gene (1)..(1575): nifA

SEQ ID NO: 277 - DNA, 1540 bp, Rahnella aquatilis
  gene (1)..(1540): 16S-1
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 278 - DNA, 1540 bp, Rahnella aquatilis
  gene (1)..(1540): 16S-2
  misc_feature (267)..(267): n is a, c, t, g, unknown or other
attgaagagtttgatcatggctcagattgaacgctggcggcaggcctaacacatgcaagtcgagcggcatcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctnacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 279 - DNA, 1540 bp, Rahnella aquatilis
  gene (1)..(1540): 16S-3
  misc_feature (455)..(455): n is a, c, t, g, unknown or other
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcancatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 280 - DNA, 1540 bp, Rahnella aquatilis
  gene (1)..(1540): 16S-4
  misc_feature (70)..(70): n is a, c, t, g, unknown or other
attgaagagtttgatcatggctcagattgaacgctggcggcaggcctaacacatgcaagtcgagcggcancgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggcttacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 281 - DNA, 1540 bp, Rahnella aquatilis
  gene (1)..(1540): 16S-5
attgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcacacttaatacgtgtgttgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 282 - DNA, 1009 bp, Rahnella aquatilis
  gene (1)..(1009): 16S-6
  misc_feature (296)..(296): n is a, c, t, g, unknown or other
  misc_feature (311)..(311): n is a, c, t, g, unknown or other
  misc_feature (973)..(973): n is a, c, t, g, unknown or other
gtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcanacttaatacgtgtgntgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtnatggtgggaactcaaaggagactgccggtgataaac

SEQ ID NO: 283 - DNA, 1519 bp, Rahnella aquatilis
  gene (1)..(1519): 16S-7
attgaagagtttgatcatggctcagattgaacgctggcggcaggcctaacacatgcaagtcgagcggcagcgggaagtagcttgctactttgccggcgagcggcggacgggtgagtaatgtcctgatggaggggataactactggaacggtagctaataccgcacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcttaatcggaattactgggcgtaaagcgcacgcaggcggttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattaataccctggtagtccacgctgtaacgatgtcgacttggaggttgtgccctgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgccagagatggcgaagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 284 - DNA, 882 bp, Rahnella aquatilis; identical to SEQ ID NO: 97
  gene (1)..(882): nifH1

SEQ ID NO: 285 - DNA, 1113 bp, Rahnella aquatilis; identical to SEQ ID NO: 98
  gene (1)..(1113): nifH2

SEQ ID NO: 286 - DNA, 1374 bp, Rahnella aquatilis; identical to SEQ ID NO: 99
  gene (1)..(1374): nifD1

SEQ ID NO: 287 - DNA, 1449 bp, Rahnella aquatilis; identical to SEQ ID NO: 100
  gene (1)..(1449): nifD2

SEQ ID NO: 288 - DNA, 1386 bp, Rahnella aquatilis; identical to SEQ ID NO: 101
  gene (1)..(1386): nifK1

SEQ ID NO: 289 - DNA, 1563 bp, Rahnella aquatilis; identical to SEQ ID NO: 102
  gene (1)..(1563): nifK2

SEQ ID NO: 290 - DNA, 2838 bp, Rahnella aquatilis; identical to SEQ ID NO: 105
  gene (1)..(2838): glnE

SEQ ID NO: 291 - DNA, 449 bp, Rahnella aquatilis
  gene (1)..(449): Prm4
agtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgg

SEQ ID NO: 292 - DNA, 500 bp, Rahnella aquatilis
  gene (1)..(500): Prm1.2
tgaacatcactgatgcacaagctacctatgtcgaagaattaactaaaaaactgcaagatgcaggcattcgcgttaaagccgacttgagaaatgagaagattggctttaaaattcgcgaacacacgctacgccgtgttccttatatgttagtttgtggcgataaagaggtcgaagcaggcaaagttgctgttcgtacccgccgcggcaaagacttaggaagcatggatgttagcgaagtcgttgacaaactgctggcggaaatccgcagcagaagtcttcatcaactggaggaataaagtattaaaggcggaaaacgagttcaaccggcgcgtcctaatcgcattaacaaagagattcgcgcgcaagaagttcgcctcacaggcgtcgatggcgagcagattggtattgtcagtctgaatgaagctcttgaaaaagctgaggaagcgggcgtcgatttagtagaaatcagtccgaatgccgagccgccagtttgtcgaatc

SEQ ID NO: 293 - DNA, 170 bp, Rahnella aquatilis
  gene (1)..(170): Prm3.1
tacagtagcgcctctcaaaaatagataaacggctcatgtacgtgggccgtttattttttctacccataatcgggaaccggtgttataatgccgcgccctcatattgtggggatttcttaatgacctatcctgggtcctaaagttgtagttgacattagcggagcactaac

SEQ ID NO: 294 - DNA, 142 bp, Rahnella aquatilis
  gene (1)..(142): Prm6.1
aattttttttcacaaagcgtagcgttattgaatcgcacattttaaactgttggccgctgtggaagcgaatattggtgaaaggtgcggttttaaggcctttttctttgactctctgtcgttacaaagttaatatgcgcgccct

SEQ ID NO: 295 - DNA, 293 bp, Rahnella aquatilis
  gene (1)..(293): Prm7.1
ttaaaaacgtgaccacgagcattaataaacgccacgaaatgtggcgtttatttattcaaaaagtatcttctttcataaaaagtgctaaatgcagtagcagcaaaattgggataagtcccatggaatacggctgttttcgctgcaatttttaactttttcgtaaaaaaagatgtttctttgagcgaacgatcaaaatatagcgttaaccggcaaaaaattattctcattagaaaatagtttgtgtaatacttgtaacgctacatggagattaacttaatctagagggttttata

SEQ ID NO: 296 - DNA, 1188 bp, Artificial Sequence; identical to SEQ ID NO: 211
  Synthetic polynucleotide
  misc_feature (1)..(1188): glnE-delta-AR-2

SEQ ID NO: 297 - DNA, 2188 bp, Artificial Sequence; identical to SEQ ID NO: 212
  Synthetic polynucleotide
  misc_feature (1)..(2188): glnE-delta-AR-2 with 500bp flank

SEQ ID NO: 298 - DNA, 524 bp, Artificial Sequence
  Synthetic polynucleotide
  misc_feature (1)..(524): delta-nifL::null-v1
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 299 - DNA, 1524 bp, Artificial Sequence
  Synthetic polynucleotide
  misc_feature (1)..(1524): delta-nifL::null-v1 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 300 - DNA, 266 bp, Artificial Sequence
  Synthetic polynucleotide
  misc_feature (1)..(266): delta-nifL::null-v2
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaagcctgccggtacagcaggttatcaccggaggcttaaaatga

SEQ ID NO: 301 - DNA, 1266 bp, Artificial Sequence
  Synthetic polynucleotide
  misc_feature (1)..(1266): delta-nifL::null-v2 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggttaaagcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 302 - DNA, 943 bp, Artificial Sequence
  Synthetic polynucleotide
  misc_feature (1)..(943): delta-nifL::Prm4
atgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatga

SEQ ID NO: 303 - DNA, 1943 bp, Artificial Sequence
  Synthetic polynucleotide
  misc_feature (1)..(1943): delta-nifL::Prm4 with 500bp flank
tgtttcgtctcgaggccgggcaactgagcggccccgttgaaaccgacctgggctggcatctgttgttgtgcgaacaaattcgcctgccgcaacccttgccgaaagccgaagccttaacgcgggtgcgtcagcaactgattgcccggcaacagaaacattatcagcgccagtggctgcaacaactgatcaacgcctgagcctgttctccttcttgttgatgcagacgggttaatgcccgttttgcacgaaaaatgcacataaattgcctgcgttgccttataacagcgcagggaaatcctgcctccggccttgtgccacaccgcgctttgcctggtttgtggtaaaaactggcccgctttgcatcctgatgcttaaaacaccccgttcagatcaacctttgggcagataagcccgcgaaaggcctgcaaattgcacggttattccgggtgagtatatgtgtgatttgggttccggcattgcgcaataaaggggagaaagacatgagcatcacggcgttatcagcatcatttcctgaggggaatatcgccagccgcttgtcgctgcaacatccttcactgttttataccgtggttgaacaatcttcggtggcgatttcgctgaccgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaatctacccttagaatcaactgttatatcagggggattcagagagatattaggaatttgcacaagcgcacaatttaaccacatcatgataacgccatgtaaaacaaagataaaaaaacaaaatgcagtgacttacatcgcaagcaaggcattttcttatccaattgctcaaagtttggcctttcatatcgcaacgaaaatgcgtaatatacgcgcccttgcggacatcagtatggtcattcctagttcatgcgcatcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatgcccgcccggaagcggcgttttcccgtccggggaatggcatggagctgcgccttatccagacgctgatcgcccatcatcgcggttctttagatctctcggtccgccctgatggcggcaccttgctgacgttacgcctgccggtacagcaggttatcaccggaggcttaaaatgacccagttacctaccgcgggcccggttatccggcgctttgatatgtctgcccagtttacggcgctttatcgcatcagcgtggcgctgagtcaggaaagcaacaccgggcgcgcactggcggcgatcctcgaagtgcttcacgatcatgcatttatgcaatacggcatggtgtgtctgtttgataaagaacgcaatgcactctttgtggaatccctgcatggcatcgacggcgaaaggaaaaaagagacccgccatgtccgttaccgcatgggggaaggcgtgatcggcgcggtgatgagccagcgtcaggcgctggtgttaccgcgcatttcagacgatcagcgttttctcgaccgcctgaatatttacgattacagcctgccgttgattggcgtgccgatccccggtgcggataatcagccatcgggcgtgctggtggcacagccgatggcgttgcacgaagaccggctgactgccagtacgcggtttttagaaatggtc

SEQ ID NO: 304 - DNA, 100 bp, Artificial Sequence
  Synthetic polynucleotide
  misc_feature (1)..(100): 100 bp upstream of junction
tggtgtccgggcgaacgtcgccaggtggcacaaattgtcagaactacgacacgactaaccgaccgcaggagtgtgcgatgaccctgaatatgatgatgga

SEQ ID NO: 305 - DNA, 100 bp, Artificial Sequence
  Synthetic polynucleotide
  misc_feature (1)..(100): 100 bp upstream of junction
cggaaaacgagttcaaacggcgcgtcccaatcgtattaatggcgagattcgcgccacggaagttcgcttaacaggtctggaaggcgagcagcttggtatt

SEQ ID NO: 306 - DNA, 100 bp, Artificial Sequence
  Synthetic polynucleotide
  misc_feature (1)..(100): 100 bp upstream of junction
cgccagagagttgaaatcgaacatttccgtaataccgccattacccaggagccgttctggttgcacagcggaaaacgttaacgaaaggatatttcgcatg

SEQ ID NO: 307 - DNA, 100 bp, Artificial Sequence
  Synthetic polynucleotide
  misc_feature (1)..(100): 100 bp upstream of junction
cgggcgaacgtcgccaggtggcacaaattgtcagaactacgacacgactaaccgaccgcaggagtgtgcgatgaccctgaatatgatgatggatgccagc

SEQ ID NO: 308 - DNA, 100 bp, Artificial Sequence
  Synthetic polynucleotide
  misc_feature (1)..(100): 100 bp upstream of junction
tcaacctaaaaaagtttgtgtaatacttgtaacgctacatggagattaactcaatctagagggtattaataatgaatcgtactaaactggtactgggcgc

SEQ ID NO: 309 - DNA, 100 bp, Artificial Sequence; identical to SEQ ID NO: 307
  Synthetic polynucleotide
  misc_feature (1)..(100): 100 bp upstream of junction

SEQ ID NO: 310 - DNA, 100 bp, Artificial Sequence
  Synthetic polynucleotide
  misc_feature (1)..(100): 100 bp upstream of junction
aattttctgcccaaatggctgggattgttcattttttgtttgccttacaacgagagtgacagtacgcgcgggtagttaactcaacatctgaccggtcgat

SEQ ID NO: 311 - DNA, 100 bp, Artificial Sequence
  Synthetic polynucleotide
  misc_feature (1)..(100): 100 bp upstream of junction
gtaaccaataaaggccaccacgccagaccacacgatagtgatggcaacactttccagctgcaccagcacctgatggcccatggtcacaccttcagcgaaa

SEQ ID NO: 312 - DNA, 100 bp, Artificial Sequence
  Synthetic polynucleotide
  misc_feature (1)..(100): 100 bp upstream of junction
tggtattgtcagtctgaatgaagctcttgaaaaagctgaggaagcgggcgtcgatttagtagaaatcagtccgaatgccgagccgccagtttgtcgaatc

SEQ ID NO: 313 - DNA, 100 bp, Artificial Sequence
  Synthetic polynucleotide
  misc_feature (1)..(100): 100 bp upstream of junction
accgatccgcaggcgcgcatttgttatgccaatccggcattctgccgccagacgggttttgcacttgagacacttttgggcgagaaccaccgtctgctgg

SEQ ID NO: 314 - DNA, 100 bp, Artificial Sequence
  Synthetic polynucleotide
  misc_feature (1)..(100): 100 bp upstream of junction
cgggaaccggtgttataatgccgcgccctcatattgtggggatttcttaatgacctatcctgggtcctaaagttgtagttgacattagcggagcactaac

SEQ ID NO: 315 - DNA, 100 bp, Artificial Sequence; identical to SEQ ID NO: 313
  Synthetic polynucleotide
  misc_feature (1)..(100): 100 bp upstream of junction

SEQ ID NO: 316 - DNA, 100 bp, Artificial Sequence; identical to SEQ ID NO: 308
  Synthetic polynucleotide
  misc_feature (1)..(100): 100 bp upstream of junction

SEQ ID NO: 317 - DNA, 100 bp, Artificial Sequence
  Synthetic polynucleotide
  misc_feature (1)..(100): 100 bp upstream of junction
gggcgacaaacggcctggtggcacaaattgtcagaactacgacacgactaactgaccgcaggagtgtgcgatgaccctgaatatgatgatggatgccggc

SEQ ID NO: 318 - DNA, 100 bp, Artificial Sequence; identical to SEQ ID NO: 317
  Synthetic polynucleotide
  misc_feature (1)..(100): 100 bp upstream of junction

SEQ ID NO: 319 - DNA, 100 bp, Artificial Sequence
  Synthetic polynucleotide
  misc_feature (1)..(100): 100 bp upstream of junction
taagaattatctggatgaatgtgccattaaatgcgcagcataatggtgcgttgtgcgggaaaactgcttttttttgaaagggttggtcagtagcggaaac

SEQ ID NO: 320 - DNA, 100 bp, Artificial Sequence
  Synthetic polynucleotide
  misc_feature (1)..(100): 100 bp upstream of junction
cgccagagagtcgaaatcgaacatttccgtaataccgcgattacccaggagccgttctggttgcacagcggaaaacgttaacgaaaggatatttcgcatg

SEQ ID NO: 321 - DNA, 100 bp, Artificial Sequence; identical to SEQ ID NO: 320
  Synthetic polynucleotide
  misc_feature (1)..(100): 100 bp upstream of junction

SEQ ID NO: 322 - DNA, 100 bp, Artificial Sequence
  Synthetic polynucleotide
  misc_feature (1)..(100): 100 bp upstream of junction
gatgatggatgctttctggttaaacgggcaacctcgttaactgactgactagcctgggcaaactgcccgggcttttttttgcaaggaatctgatttcatg

SEQ ID NO: 323 - DNA, 100 bp, Artificial Sequence; identical to SEQ ID NO: 313
  Synthetic polynucleotide
  misc_feature (1)..(100): 100 bp upstream of junction

SEQ ID NO: 324 - DNA, 100 bp, Artificial Sequence
  Synthetic polynucleotide
  misc_feature (1)..(100): 100 bp upstream of junction
catcggacaccaccagcttacaaattgcctgattgcggccccgatggccggtatcactgaccgaccatttcgtgccttatgtcatgcgatgggggctggg

SEQ ID NO: 325 - DNA, 100 bp, Artificial Sequence
  Synthetic polynucleotide
  misc_feature (1)..(100): 100 bp upstream of junction
tcttcaacaactggaggaataaggtattaaaggcggaaaacgagttcaaacggcacgtccgaatcgtatcaatggcgagattcgcgccctggaagttcgc

SEQ ID NO: 326 - DNA, 100 bp, Artificial Sequence
  Synthetic polynucleotide
  misc_feature (1)..(100): 100 bp upstream of junction
tccgggttcggcttaccccgccgcgttttgcgcacggtgtcggacaatttgtcataactgcgacacaggagtttgcgatgaccctgaatatgatgctcga

SEQ ID NO: 327 - DNA, 100 bp, Artificial Sequence
  Synthetic polynucleotide
  misc_feature (1)..(100): 100 bp upstream of junction
atcgcagcgtctttgaatatttccgtcgccaggcgctggctgccgagccgttctggctgcatagtggaaaacgataatttcaggccagggagcccttatg

SEQ ID NO: 328 - DNA, 100 bp, Artificial Sequence; identical to SEQ ID NO: 326
  Synthetic polynucleotide
  misc_feature (1)..(100): 100 bp upstream of junction

SEQ ID NO: 329 - DNA, 100 bp, Artificial Sequence
  Synthetic polynucleotide
  misc_feature (1)..(100): 100 bp upstream of junction
tcactttttagcaaagttgcactggacaaaaggtaccacaattggtgtactgatactcgacacagcattagtgtcgatttttcatataaaggtaattttg

SEQ ID NO: 330 - DNA, 100 bp, Artificial Sequence; identical to SEQ ID NO: 326
  Synthetic polynucleotide
  misc_feature (1)..(100): 100 bp upstream of junction

SEQ ID NO: 331 - DNA, 100 bp, Artificial Sequence
  Synthetic polynucleotide
  misc_feature (1)..(100): 100 bp upstream of junction
gttctcctttgcaatagcagggaagaggcgccagaaccgccagcgttgaagcagtttgaacgcgttcagtgtataatccgaaacttaatttcggtttgga

SEQ ID NO: 332 - DNA, 100 bp, Artificial Sequence; identical to SEQ ID NO: 326
  Synthetic polynucleotide
  misc_feature (1)..(100): 100 bp upstream of junction

SEQ ID NO: 333 - DNA, 100 bp, Artificial Sequence
  Synthetic polynucleotide
  misc_feature (1)..(100): 100 bp upstream of junction
gatatgcctgaagtattcaattacttaggcatttacttaacgcaggcaggcaattttgatgctgcctatgaagcgtttgattctgtacttgagcttgatc

SEQ ID NO: 334 - DNA, 100 bp, Artificial Sequence; identical to SEQ ID NO: 312
  Synthetic polynucleotide
  misc_feature (1)..(100): 100 bp upstream of junction

SEQ ID NO: 335 - DNA, 100 bp, Artificial Sequence
  Synthetic polynucleotide
  misc_feature (1)..(100): 100 bp upstream of junction
tgcaaattgcacggttattccgggtgagtatatgtgtgatttgggttccggcattgcgcaataaaggggagaaagacatgagcatcacggcgttatcagc

SEQ ID NO: 336 - DNA, 100 bp, Artificial Sequence
  Synthetic polynucleotide
  misc_feature (1)..(100): 100 bp upstream of junction
tcagggctgcggatgtcgggcgtttcacaacacaaaatgttgtaaatgcgacacagccgggcctgaaaccaggagcgtgtgatgacctttaatatgatgc

SEQ ID NO: 337 - DNA, 100 bp, Artificial Sequence
  Synthetic polynucleotide
  misc_feature (1)..(100): 100 bp upstream of junction
cggaaaacgagttcaaacggcacgtccgaatcgtatcaatggcgagattcgcgcccaggaagttcgcttaactggtctggaaggtgagcagctgggtatt

SEQ ID NO: 338 - DNA, 100 bp, Artificial Sequence
  Synthetic polynucleotide
  misc_feature (1)..(100): 100 bp downstream of junction
ttcttggttctctggagcgctttatcggcatcctgactgaagaatttgcaggcttcttcccaacctggcttgcacccgtgcaggtagttgtgatgaacat

SEQ ID NO: 339 - DNA, 100 bp, Artificial Sequence
  Synthetic polynucleotide
  misc_feature (1)..(100): 100 bp downstream of junction
gcgatagaactcacttcacgccccgaagggggaagctgcctgaccctacgattcccgctatttcattcactgaccggaggttcaaaatgacccagcgaac

SEQ ID NO: 340 - DNA, 100 bp, Artificial Sequence
  Synthetic polynucleotide
  misc_feature (1)..(100): 100 bp downstream of junction
tccctgtgcgccgcgtcgccgatggtggccagccaactggcgcgctacccgatcctgctcgatgaactgctcgacccgaacacgctctatcaaccgacgg

SEQ ID NO: 341 - DNA, 100 bp, Artificial Sequence
  Synthetic polynucleotide
  misc_feature (1)..(100): 100 bp downstream of junction
cgttctgtaataataaccggacaattcggactgattaaaaaagcgccctcgcggcgctttttttatattctcgactccatttaaaataaaaaatccaatc

SEQ ID NO: 342 - DNA, 100 bp, Artificial Sequence
  Synthetic polynucleotide
  misc_feature (1)..(100): 100 bp downstream of junction
aactcacttcacgccccgaagggggaagctgcctgaccctacgattcccgctatttcattcactgaccggaggttcaaaatgacccagcgaaccgagtcg

SEQ ID NO: 343 - DNA, 100 bp, Artificial Sequence
  Synthetic polynucleotide
  misc_feature (1)..(100): 100 bp downstream of junction
cgcgtcaggttgaacgtaaaaaagtcggtctgcgcaaagcacgtcgtcgtccgcagttctccaaacgttaattggtttctgcttcggcagaacgattggc

SEQ ID NO: 344 - DNA, 100 bp, Artificial Sequence; identical to SEQ ID NO: 342
  Synthetic polynucleotide
  misc_feature (1)..(100): 100 bp downstream of junction

SEQ ID NO: 345 - DNA, 100 bp, Artificial Sequence
  Synthetic polynucleotide
  misc_feature (1)..(100): 100 bp downstream of junction
ccgatccccatcactgtgtgtcttgtattacagtgccgcttcgtcggcttcgccggtacgaatacgaatgacgcgttgcagctcagcaacgaaaattttg

SEQ ID NO: 346 - DNA, 100 bp, Artificial Sequence
  Synthetic polynucleotide
  misc_feature (1)..(100): 100 bp downstream of junction
ccgtctctgaagctctcggtgaacattgttgcgaggcaggatgcgagctggttgtgttttgacattaccgataatgtgccgcgtgaacgggtgcgttatg

SEQ ID NO: 347 - DNA, 100 bp, Artificial Sequence
  Synthetic polynucleotide
  misc_feature (1)..(100): 100 bp downstream of junction
tgaacatcactgatgcacaagctacctatgtcgaagaattaactaaaaaactgcaagatgcaggcattcgcgttaaagccgacttgagaaatgagaagat

SEQ ID NO: 348 - DNA, 100 bp, Artificial Sequence; identical to SEQ ID NO: 346
  Synthetic polynucleotide
  misc_feature (1)..(100): 100 bp downstream of junction

SEQ ID NO: 349 - DNA, 100 bp, Artificial Sequence
  Synthetic polynucleotide
  misc_feature (1)..(100): 100 bp downstream of junction
tacagtagcgcctctcaaaaatagataaacggctcatgtacgtgggccgtttattttttctacccataatcgggaaccggtgttataatgccgcgccctc

SEQ ID NO: 350 - DNA, 100 bp, Artificial Sequence
  Synthetic polynucleotide
  misc_feature (1)..(100): 100 bp downstream of junction
aactcacttcacaccccgaagggggaagttgcctgaccctacgattcccgctatttcattcactgaccggaggttcaaaatgacccagcgaaccgagtcg

SEQ ID NO: 351 - DNA, 100 bp, Artificial Sequence
  Synthetic polynucleotide
  misc_feature (1)..(100): 100 bp downstream of junction
cgtcctgtaataataaccggacaattcggactgattaaaaaagcgcccttgtggcgctttttttatattcccgcctccatttaaaataaaaaatccaatc

SEQ ID NO: 352 - DNA, 100 bp, Artificial Sequence
  Synthetic polynucleotide
  misc_feature (1)..(100): 100 bp downstream of junction
ggacatcatcgcgacaaacaatattaataccggcaaccacaccggcaatttacgagactgcgcaggcatcctttctcccgtcaatttctgtcaaataaag

SEQ ID NO: 353 - DNA, 100 bp, Artificial Sequence; identical to SEQ ID NO: 350
  Synthetic polynucleotide
  misc_feature (1)..(100): 100 bp downstream of junction

SEQ ID NO: 354 - DNA, 100 bp, Artificial Sequence
  Synthetic polynucleotide
  misc_feature (1)..(100): 100 bp downstream of junction
tttaacgatctgattggcgatgatgaaacggattcgccggaagatgcgctttctgagagctggcgcgaattgtggcaggatgcgttgcaggaggaggatt

SEQ ID NO: 355 - DNA, 100 bp, Artificial Sequence
  Synthetic polynucleotide
  misc_feature (1)..(100): 100 bp downstream of junction
gcactgaaacacctcatttccctgtgtgccgcgtcgccgatggttgccagtcagctggcgcgctacccgatcctgcttgatgaattgctcgacccgaata

SEQ ID NO: 356 - DNA, 100 bp, Artificial Sequence
  Synthetic polynucleotide
  misc_feature (1)..(100): 100 bp downstream of junction
gcgctcaaacagttaatccgtctgtgtgccgcctcgccgatggtcgcgacacaacttgcacgtcatcctttattgctcgatgaactgctcgacccgcgca

SEQ ID NO: 357 - DNA, 100 bp, Artificial Sequence
  Synthetic polynucleotide
  misc_feature (1)..(100): 100 bp downstream of junction
agtctgaactcatcctgcggcagtcggtgagacgtatttttgaccaaagagtgatctacatcacggaattttgtggttgttgctgcttaaaagggcaaat

SEQ ID NO: 358 - DNA, 100 bp, Artificial Sequence; identical to SEQ ID NO: 346
  Synthetic polynucleotide
  misc_feature (1)..(100): 100 bp downstream of junction

SEQ ID NO: 359 - DNA, 100 bp, Artificial Sequence
  Synthetic polynucleotide
  misc_feature (1)..(100): 100 bp downstream of junction
gccattgagctggcttcccgaccgcagggcggcacctgcctgaccctgcgtttcccgctgtttaacaccctgaccggaggtgaagcatgatccctgaatc

SEQ ID NO: 360 - DNA, 100 bp, Artificial Sequence
  Synthetic polynucleotide
  misc_feature (1)..(100): 100 bp downstream of junction
agcgtcaggtaccggtcatgattcaccgtgcgattctcggttccctggagcgcttcattggcatcctgaccgaagagttcgctggcttcttcccaacctg

SEQ ID NO: 361 - DNA, 100 bp, Artificial Sequence
  Synthetic polynucleotide
  misc_feature (1)..(100): 100 bp downstream of junction
gcgctgaagcacctgatcacgctctgcgcggcgtcgccgatggtcgccagccagctggcgcgccacccgctgctgctggatgagctgctggatcccaaca

SEQ ID NO: 362 - DNA, 100 bp, Artificial Sequence
  Synthetic polynucleotide
  misc_feature (1)..(100): 100 bp downstream of junction
gcccgctgaccgaccagaacttccaccttggactcggctatacccttggcgtgacggcgcgcgataactgggactacatccccattccggtgatcttacc

SEQ ID NO: 363 - DNA, 100 bp, Artificial Sequence; identical to SEQ ID NO: 359
  Synthetic polynucleotide
  misc_feature (1)..(100): 100 bp downstream of junction

SEQ ID NO: 364 - DNA, 100 bp, Artificial Sequence
  Synthetic polynucleotide
  misc_feature (1)..(100): 100 bp downstream of junction
gctaaagttctcggctaatcgctgataacatttgacgcaatgcgcaataaaagggcatcatttgatgccctttttgcacgctttcataccagaacctggc

SEQ ID NO: 365 - DNA, 100 bp, Artificial Sequence; identical to SEQ ID NO: 359
  Synthetic polynucleotide
  misc_feature (1)..(100): 100 bp downstream of junction

SEQ ID NO: 366 - DNA, 100 bp, Artificial Sequence
  Synthetic polynucleotide
  misc_feature (1)..(100): 100 bp downstream of junction
cgccgtcctcgcagtaccattgcaaccgactttacagcaagaagtgattctggcacgcatggaacaaattcttgccagtcgggctttatccgatgacgaa

SEQ ID NO: 367 - DNA, 100 bp, Artificial Sequence; identical to SEQ ID NO: 359
  Synthetic polynucleotide
  misc_feature (1)..(100): 100 bp downstream of junction

SEQ ID NO: 368 - DNA, 100 bp, Artificial Sequence
  Synthetic polynucleotide
  misc_feature (1)..(100): 100 bp downstream of junction
tctttagatctctcggtccgccctgatggcggcaccttgctgacgttacgcctgccggtacagcaggttatcaccggaggcttaaaatgacccagttacc

SEQ ID NO: 369 - DNA, 100 bp, Artificial Sequence
  Synthetic polynucleotide
  misc_feature (1)..(100): 100 bp downstream of junction
tgaatatcactgactcacaagctacctatgtcgaagaattaactaaaaaactgcaagatgcaggcattcgcgttaaagccgacttgagaaatgagaagat

SEQ ID NO: 370 - DNA, 100 bp, Artificial Sequence
  Synthetic polynucleotide
  misc_feature (1)..(100): 100 bp downstream of junction
ctggggtcactggagcgctttatcggcatcctgaccgaagaatttgccggtttcttcccgacctggctggcccctgttcaggttgtggtgatgaatatca

SEQ ID NO: 371 - DNA, 100 bp, Artificial Sequence
  Synthetic polynucleotide
  misc_feature (1)..(100): 100 bp downstream of junction
gcaatagaactaactacccgccctgaaggcggtacctgcctgaccctgcgattcccgttatttcattcactgaccggaggcccacgatgacccagcgacc

SEQ ID NO: 372 - DNA, 200 bp, Artificial Sequence
  Synthetic polynucleotide
  misc_feature (1)..(200): disrupted nifL gene / PinfC
tggtgtccgggcgaacgtcgccaggtggcacaaattgtcagaactacgacacgactaaccgaccgcaggagtgtgcgatgaccctgaatatgatgatggattcttggttctctggagcgctttatcggcatcctgactgaagaatttgcaggcttcttcccaacctggcttgcacccgtgcaggtagttgtgatgaacat

SEQ ID NO: 373 - DNA, 200 bp, Artificial Sequence
  Synthetic polynucleotide
  misc_feature (1)..(200): PinfC / disrupted nifL gene
cggaaaacgagttcaaacggcgcgtcccaatcgtattaatggcgagattcgcgccacggaagttcgcttaacaggtctggaaggcgagcagcttggtattgcgatagaactcacttcacgccccgaagggggaagctgcctgaccctacgattcccgctatttcattcactgaccggaggttcaaaatgacccagcgaac

SEQ ID NO: 374 - DNA, 200 bp, Artificial Sequence
  Synthetic polynucleotide
  misc_feature (1)..(200): 5' UTR and ATG / truncated glnE gene
cgccagagagttgaaatcgaacatttccgtaataccgccattacccaggagccgttctggttgcacagcggaaaacgttaacgaaaggatatttcgcatgtccctgtgcgccgcgtcgccgatggtggccagccaactggcgcgctacccgatcctgctcgatgaactgctcgacccgaacacgctctatcaaccgacgg

SEQ ID NO: 375 - DNA, 200 bp, Artificial Sequence
  Synthetic polynucleotide
  misc_feature (1)..(200): disrupted nifL gene / Prm1
cgggcgaacgtcgccaggtggcacaaattgtcagaactacgacacgactaaccgaccgcaggagtgtgcgatgaccctgaatatgatgatggatgccagccgttctgtaataataaccggacaattcggactgattaaaaaagcgccctcgcggcgctttttttatattctcgactccatttaaaataaaaaatccaatc

SEQ ID NO: 376 - DNA, 200 bp, Artificial Sequence
  Synthetic polynucleotide
  misc_feature (1)..(200): Prm1 / disrupted nifL gene
tcaacctaaaaaagtttgtgtaatacttgtaacgctacatggagattaactcaatctagagggtattaataatgaatcgtactaaactggtactgggcgcaactcacttcacgccccgaagggggaagctgcctgaccctacgattcccgctatttcattcactgaccggaggttcaaaatgacccagcgaaccgagtcg

SEQ ID NO: 377 - DNA, 200 bp, Artificial Sequence
  Synthetic polynucleotide
  misc_feature (1)..(200): disrupted nifL gene / Prm7
cgggcgaacgtcgccaggtggcacaaattgtcagaactacgacacgactaaccgaccgcaggagtgtgcgatgaccctgaatatgatgatggatgccagccgcgtcaggttgaacgtaaaaaagtcggtctgcgcaaagcacgtcgtcgtccgcagttctccaaacgttaattggtttctgcttcggcagaacgattggc

SEQ ID NO: 378 - DNA, 200 bp, Artificial Sequence
  Synthetic polynucleotide
  misc_feature (1)..(200): Prm4 / disrupted nifL gene
aattttctgcccaaatggctgggattgttcattttttgtttgccttacaacgagagtgacagtacgcgcgggtagttaactcaacatctgaccggtcgataactcacttcacgccccgaagggggaagctgcctgaccctacgattcccgctatttcattcactgaccggaggttcaaaatgacccagcgaaccgagtcg

SEQ ID NO: 379 - DNA, 200 bp, Artificial Sequence
  Synthetic polynucleotide
  misc_feature (1)..(200): 5' UTR up to ATG-4bp of amtB gene / disrupted amtB gene
gtaaccaataaaggccaccacgccagaccacacgatagtgatggcaacactttccagctgcaccagcacctgatggcccatggtcacaccttcagcgaaaccgatccccatcactgtgtgtcttgtattacagtgccgcttcgtcggcttcgccggtacgaatacgaatgacgcgttgcagctcagcaacgaaaattttg

SEQ ID NO: 380 - DNA, 200 bp, Artificial Sequence
  Synthetic polynucleotide
  misc_feature (1)..(200): Prm1.2 / disrupted nifL gene
tggtattgtcagtctgaatgaagctcttgaaaaagctgaggaagcgggcgtcgatttagtagaaatcagtccgaatgccgagccgccagtttgtcgaatcccgtctctgaagctctcggtgaacattgttgcgaggcaggatgcgagctggttgtgttttgacattaccgataatgtgccgcgtgaacgggtgcgttatg

SEQ ID NO: 381 - DNA, 200 bp, Artificial Sequence
  Synthetic polynucleotide
  misc_feature (1)..(200): disrupted nifL gene / Prm1.2
accgatccgcaggcgcgcatttgttatgccaatccggcattctgccgccagacgggttttgcacttgagacacttttgggcgagaaccaccgtctgctggtgaacatcactgatgcacaagctacctatgtcgaagaattaactaaaaaactgcaagatgcaggcattcgcgttaaagccgacttgagaaatgagaagat

SEQ ID NO: 382 - DNA, 200 bp, Artificial Sequence
  Synthetic polynucleotide
  misc_feature (1)..(200): Prm3.1 / disrupted nifL gene
cgggaaccggtgttataatgccgcgccctcatattgtggggatttcttaatgacctatcctgggtcctaaagttgtagttgacattagcggagcactaacccgtctctgaagctctcggtgaacattgttgcgaggcaggatgcgagctggttgtgttttgacattaccgataatgtgccgcgtgaacgggtgcgttatg

SEQ ID NO: 383 - DNA, 200 bp, Artificial Sequence
  Synthetic polynucleotide
  misc_feature (1)..(200): disrupted nifL gene / Prm3.1
accgatccgcaggcgcgcatttgttatgccaatccggcattctgccgccagacgggttttgcacttgagacacttttgggcgagaaccaccgtctgctggtacagtagcgcctctcaaaaatagataaacggctcatgtacgtgggccgtttattttttctacccataatcgggaaccggtgttataatgccgcgccctc

SEQ ID NO: 384 - DNA, 200 bp, Artificial Sequence
  Synthetic polynucleotide
  misc_feature (1)..(200): Prm1 / disrupted nifL gene
tcaacctaaaaaagtttgtgtaatacttgtaacgctacatggagattaactcaatctagagggtattaataatgaatcgtactaaactggtactgggcgcaactcacttcacaccccgaagggggaagttgcctgaccctacgattcccgctatttcattcactgaccggaggttcaaaatgacccagcgaaccgagtcg

SEQ ID NO: 385 - DNA, 200 bp, Artificial Sequence
  Synthetic polynucleotide
  misc_feature (1)..(200): disrupted nifL gene / Prm1
gggcgacaaacggcctggtggcacaaattgtcagaactacgacacgactaactgaccgcaggagtgtgcgatgaccctgaatatgatgatggatgccggccgtcctgtaataataaccggacaattcggactgattaaaaaagcgcccttgtggcgctttttttatattcccgcctccatttaaaataaaaaatccaatc

SEQ ID NO: 386 - DNA, 200 bp, Artificial Sequence
  Synthetic polynucleotide
  misc_feature (1)..(200): disrupted nifL gene / Prm5
gggcgacaaacggcctggtggcacaaattgtcagaactacgacacgactaactgaccgcaggagtgtgcgatgaccctgaatatgatgatggatgccggcggacatcatcgcgacaaacaatattaataccggcaaccacaccggcaatttacgagactgcgcaggcatcctttctcccgtcaatttctgtcaaataaag

SEQ ID NO: 387 - DNA, 200 bp, Artificial Sequence
  Synthetic polynucleotide
  misc_feature (1)..(200): Prm5 / disrupted nifL gene
taagaattatctggatgaatgtgccattaaatgcgcagcataatggtgcgttgtgcgggaaaactgcttttttttgaaagggttggtcagtagcggaaacaactcacttcacaccccgaagggggaagttgcctgaccctacgattcccgctatttcattcactgaccggaggttcaaaatgacccagcgaaccgagtcg

SEQ ID NO: 388 - DNA, 200 bp, Artificial Sequence
  Synthetic polynucleotide
  misc_feature (1)..(200): 5' UTR and ATG / truncated glnE gene
cgccagagagtcgaaatcgaacatttccgtaataccgcgattacccaggagccgttctggttgcacagcggaaaacgttaacgaaaggatatttcgcatgtttaacgatctgattggcgatgatgaaacggattcgccggaagatgcgctttctgagagctggcgcgaattgtggcaggatgcgttgcaggaggaggatt

SEQ ID NO: 389 - DNA, 200 bp, Artificial Sequence
  Synthetic polynucleotide
  misc_feature (1)..(200): 5' UTR and ATG / truncated glnE gene
cgccagagagtcgaaatcgaacatttccgtaataccgcgattacccaggagccgttctggttgcacagcggaaaacgttaacgaaaggatatttcgcatggcactgaaacacctcatttccctgtgtgccgcgtcgccgatggttgccagtcagctggcgcgctacccgatcctgcttgatgaattgctcgacccgaata

SEQ ID NO: 390 - DNA, 200 bp, Artificial Sequence
  Synthetic polynucleotide
  misc_feature (1)..(200): 5' UTR and ATG / truncated glnE gene
gatgatggatgctttctggttaaacgggcaacctcgttaactgactgactagcctgggcaaactgcccgggcttttttttgcaaggaatctgatttcatggcgctcaaacagttaatccgtctgtgtgccgcctcgccgatggtcgcgacacaacttgcacgtcatcctttattgctcgatgaactgctcgacccgcgca

SEQ ID NO: 391 - DNA, 200 bp, Artificial Sequence
  Synthetic polynucleotide
  misc_feature (1)..(200): disrupted nifL gene / Prm4
accgatccgcaggcgcgcatttgttatgccaatccggcattctgccgccagacgggttttgcacttgagacacttttgggcgagaaccaccgtctgctggagtctgaactcatcctgcggcagtcggtgagacgtatttttgaccaaagagtgatctacatcacggaattttgtggttgttgctgcttaaaagggcaaat

SEQ ID NO: 392 - DNA, 200 bp, Artificial Sequence
  Synthetic polynucleotide
  misc_feature (1)..(200): Prm4 / disrupted nifL gene
catcggacaccaccagcttacaaattgcctgattgcggccccgatggccggtatcactgaccgaccatttcgtgccttatgtcatgcgatgggggctgggccgtctctgaagctctcggtgaacattgttgcgaggcaggatgcgagctggttgtgttttgacattaccgataatgtgccgcgtgaacgggtgcgttatg

SEQ ID NO: 393 - DNA, 200 bp, Artificial Sequence
  Synthetic polynucleotide
  misc_feature (1)..(200): PinfC / disrupted nifL gene
tcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatc

SEQ ID NO: 394 - DNA, 200 bp, Artificial Sequence
  Synthetic polynucleotide
  misc_feature (1)..(200): disrupted nifL gene / PinfC
tccgggttcggcttaccccgccgcgttttgcgcacggtgtcggacaatttgtcataactgcgacacaggagtttgcgatgaccctgaatatgatgctcgaagcgtcaggtaccggtcatgattcaccgtgcgattctcggttccctggagcgcttcattggcatcctgaccgaagagttcgctggcttcttcccaacctg

SEQ ID NO: 395 - DNA, 200 bp, Artificial Sequence
  Synthetic polynucleotide
  misc_feature (1)..(200): 5' UTR and ATG / truncated glnE gene
atcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaaca

SEQ ID NO: 396 - DNA, 200 bp, Artificial Sequence
  Synthetic polynucleotide
  misc_feature (1)..(200): disrupted nifL gene / Prm1.2
tccgggttcggcttaccccgccgcgttttgcgcacggtgtcggacaatttgtcataactgcgacacaggagtttgcgatgaccctgaatatgatgctcgagcccgctgaccgaccagaacttccaccttggactcggctatacccttggcgtgacggcgcgcgataactgggactacatccccattccggtgatcttacc

SEQ ID NO: 397 - DNA, 200 bp, Artificial Sequence
  Synthetic polynucleotide
  misc_feature (1)..(200): Prm1.2 / disrupted nifL gene
tcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatc

SEQ ID NO: 398 - DNA, 200 bp, Artificial Sequence
  Synthetic polynucleotide
  misc_feature (1)..(200): disrupted nifL gene / Prm6.2
tccgggttcggcttaccccgccgcgttttgcgcacggtgtcggacaatttgtcataactgcgacacaggagtttgcgatgaccctgaatatgatgctcgagctaaagttctcggctaatcgctgataacatttgacgcaatgcgcaataaaagggcatcatttgatgccctttttgcacgctttcataccagaacctggc

SEQ ID NO: 399 - DNA, 200 bp, Artificial Sequence
  Synthetic polynucleotide
  misc_feature (1)..(200): Prm6.2 / disrupted nifL gene
gttctcctttgcaatagcagggaagaggcgccagaaccgccagcgttgaagcagtttgaacgcgttcagtgtataatccgaaacttaatttcggtttggagccattgagctggcttcccgaccgcagggcggcacctgcctgaccctgcgtttcccgctgtttaacaccctgaccggaggtgaagcatgatccctgaatc

SEQ ID NO: 400 - DNA, 200 bp, Artificial Sequence
  Synthetic polynucleotide
  misc_feature (1)..(200): disrupted nifL gene / Prm8.2
tccgggttcggcttaccccgccgcgttttgcgcacggtgtcggacaatttgtcataactgcgacacaggagtttgcgatgaccctgaatatgatgctcgacgccgtcctcgcagtaccattgcaaccgactttacagcaagaagtgattctggcacgcatggaacaaattcttgccagtcgggctttatccgatgacgaa

SEQ ID NO: 401 - DNA, 200 bp, Artificial Sequence
  Synthetic polynucleotide
  misc_feature (1)..(200): Prm8.2 / disrupted nifL gene
gatatgcctgaagtattcaattacttaggcatttacttaacgcaggcaggcaattttgatgctgcctatgaagcgtttgattctgtacttgagcttgatcgccattgagctggcttcccgaccgcagggcggcacctgcctgaccctgcgtttcccgctgtttaacaccctgaccggaggtgaagcatgatccctgaatc

SEQ ID NO: 402 - DNA, 200 bp, Artificial Sequence
  Synthetic polynucleotide
  misc_feature (1)..(200): PinfC / disrupted nifL gene
tggtattgtcagtctgaatgaagctcttgaaaaagctgaggaagcgggcgtcgatttagtagaaatcagtccgaatgccgagccgccagtttgtcgaatctctttagatctctcggtccgccctgatggcggcaccttgctgacgttacgcctgccggtacagcaggttatcaccggaggcttaaaatgacccagttacc

SEQ ID NO: 403 - DNA, 200 bp, Artificial Sequence
  Synthetic polynucleotide
  misc_feature (1)..(200): disrupted nifL gene / PinfC
tgcaaattgcacggttattccgggtgagtatatgtgtgatttgggttccggcattgcgcaataaaggggagaaagacatgagcatcacggcgttatcagctgaatatcactgactcacaagctacctatgtcgaagaattaactaaaaaactgcaagatgcaggcattcgcgttaaagccgacttgagaaatgagaagat

SEQ ID NO: 404 - DNA, 200 bp, Artificial Sequence
  Synthetic polynucleotide
  misc_feature (1)..(200): disrupted nifL gene / PinfC
tcagggctgcggatgtcgggcgtttcacaacacaaaatgttgtaaatgcgacacagccgggcctgaaaccaggagcgtgtgatgacctttaatatgatgcctggggtcactggagcgctttatcggcatcctgaccgaagaatttgccggtttcttcccgacctggctggcccctgttcaggttgtggtgatgaatatca

SEQ ID NO: 405 - DNA, 200 bp, Artificial Sequence
  Synthetic polynucleotide
  misc_feature (1)..(200): PinfC / disrupted nifL gene
cggaaaacgagttcaaacggcacgtccgaatcgtatcaatggcgagattcgcgcccaggaagttcgcttaactggtctggaaggtgagcagctgggtattgcaatagaactaactacccgccctgaaggcggtacctgcctgaccctgcgattcccgttatttcattcactgaccggaggcccacgatgacccagcgacc

SEQ ID NO: 406 - DNA, 20 bp, Artificial Sequence
  Synthetic primer
caagaagttcgcctcacagg

SEQ ID NO: 407 - DNA, 20 bp, Artificial Sequence
  Synthetic primer
tgcctcgcaacaatgttcac

SEQ ID NO: 408 - DNA, 20 bp, Artificial Sequence
  Synthetic primer
cgccctcatattgtggggat

SEQ ID NO: 409 - DNA, 19 bp, Artificial Sequence
  Synthetic primer
ggcataacgcacccgttca

SEQ ID NO: 410 - DNA, 15 bp, Artificial Sequence
  Synthetic probe
tctgaagctctcggt

SEQ ID NO: 411 - DNA, 22 bp, Artificial Sequence
  Synthetic primer
taaactggtactgggcgcaact

SEQ ID NO: 412 - DNA, 23 bp, Artificial Sequence
  Synthetic primer
caaatcgaagcgccagacggtat

SEQ ID NO: 413 - DNA, 15 bp, Artificial Sequence
  Synthetic probe
gaccctacgattccc

SEQ ID NO: 414 - DNA, 20 bp, Artificial Sequence
  Synthetic primer
ggtgcactctttgcatggtt

SEQ ID NO: 415 - DNA, 20 bp, Artificial Sequence
  Synthetic primer
gcgcagtctcgtaaattgcc

SEQ ID NO: 416 - DNA, 15 bp, Artificial Sequence
  Synthetic probe
gcgatgaccctgaat

SEQ ID NO: 417 - DNA, 19 bp, Artificial Sequence
  Synthetic primer
ctcggcagcatggacgtaa

SEQ ID NO: 418 - DNA, 21 bp, Artificial Sequence
  Synthetic primer
agggtgttaaacagcgggaaa

SEQ ID NO: 419 - DNA, 15 bp, Artificial Sequence
  Synthetic probe
tccgaatcgtatcaa

SEQ ID NO: 420 - DNA, 20 bp, Artificial Sequence
  Synthetic primer
gagccgttctggctgcatag

SEQ ID NO: 421 - DNA, 18 bp, Artificial Sequence
  Synthetic primer
gccgtcggctgatagagg

SEQ ID NO: 422 - DNA, 15 bp, Artificial Sequence
  Synthetic probe
tgaagcacctgatca

SEQ ID NO: 423 - DNA, 20 bp, Artificial Sequence
  Synthetic primer
ggaaaacgagttcaaccggc

SEQ ID NO: 424 - DNA, 20 bp, Artificial Sequence
  Synthetic primer
gggcggaccgagagatctaa

SEQ ID NO: 425 - DNA, 100 bp, Artificial Sequence; identical to SEQ ID NO: 326
  Synthetic polynucleotide
  misc_feature (1)..(100): 100 bp upstream of junction

SEQ ID NO: 426 - DNA, 100 bp, Artificial Sequence; identical to SEQ ID NO: 329
  Synthetic polynucleotide
  misc_feature (1)..(100): 100 bp upstream of junction

SEQ ID NO: 427 - DNA, 100 bp, Artificial Sequence; identical to SEQ ID NO: 327
  Synthetic polynucleotide
  misc_feature (1)..(100): 100 bp upstream of junction

SEQ ID NO: 428 - DNA, 100 bp, Artificial Sequence
  Synthetic polynucleotide
  misc_feature (1)..(100): 100 bp upstream of junction
acgcgcgctcaccggagccggcttgagctgcacaacgttcgaaagcggcaatgaggtgctagatgccctcaccaccaaaaccccggatgtactgctgtca

SEQ ID NO: 429 - DNA, 100 bp, Artificial Sequence
  Synthetic polynucleotide
  misc_feature (1)..(100): 100 bp upstream of junction
cgcgctcaccggagccggcttgagctgcacaacgttcgaaagcggcaatgaggtgctagatgccctcaccaccaaaaccccggatgtactgctgtcagct

SEQ ID NO: 430 - DNA, 100 bp, Artificial Sequence; identical to SEQ ID NO: 326
  Synthetic polynucleotide
  misc_feature (1)..(100): 100 bp upstream of junction

SEQ ID NO: 431 - DNA, 100 bp, Artificial Sequence; identical to SEQ ID NO: 325
  Synthetic polynucleotide
  misc_feature (1)..(100): 100 bp upstream of junction

SEQ ID NO: 432 - DNA, 100 bp, Artificial Sequence
  Synthetic polynucleotide
  misc_feature (1)..(100): 100 bp upstream of junction
agctcattgcggcgcgcaccgaatttatcgaccagctgctgcagcggttgtggatcgcctacggttttgaatccgtctgcgatctggcgctggtggccgt

SEQ ID NO: 433 - DNA, 100 bp, Artificial Sequence
  Synthetic polynucleotide
  misc_feature (1)..(100): 100 bp upstream of junction
gttgtggatcgcctacggttttgaatccgtctgcgatctggcgctggtggccgtccttgattatggccgcggcgagctgcacccgctctctgacgtcgca

SEQ ID NO: 434 - DNA, 100 bp, Artificial Sequence
  Synthetic polynucleotide
  misc_feature (1)..(100): 100 bp upstream of junction
acggcagggttttgtgtttttgaaaacaaatgcctgaaatcggctataaagtgtgatctgcatcaaaatgccatgcgccaaacttaaggaatattaagga

SEQ ID NO: 435 - DNA, 100 bp, Artificial Sequence
  Synthetic polynucleotide
  misc_feature (1)..(100): 100 bp upstream of junction
ggaacgcgacaatgttgtgccgcagggatgcgggataatgctttatttttcagccagataaaaaattcgtcactggtacgtcgtttgcagcaggaaggta

SEQ ID NO: 436 - DNA, 100 bp, Artificial Sequence; identical to SEQ ID NO: 362
  Synthetic polynucleotide
  misc_feature (1)..(100): 100 bp downstream of junction

SEQ ID NO: 437 - DNA, 100 bp, Artificial Sequence; identical to SEQ ID NO: 359
  Synthetic polynucleotide
  misc_feature (1)..(100): 100 bp downstream of junction

SEQ ID NO: 438 - DNA, 100 bp, Artificial Sequence; identical to SEQ ID NO: 361
  Synthetic polynucleotide
  misc_feature (1)..(100): 100 bp downstream of junction

SEQ ID NO: 439 - DNA, 100 bp, Artificial Sequence
  Synthetic polynucleotide
  misc_feature (1)..(100): 100 bp downstream of junction
gctatccgtatgccgggaatggatggtctggcgctgctcaaacagattaagcagcgtcatccaatgcttccggtcatcataatgaccgcacattccgatc

SEQ ID NO: 440 - DNA, 100 bp, Artificial Sequence
  Synthetic polynucleotide
  misc_feature (1)..(100): 100 bp downstream of junction
atccgtatgccgggaatggatggtctggcgctgctcaaacagattaagcagcgtcatccaatgcttccggtcatcataatgaccgcacattccgatctgg

SEQ ID NO: 441 - DNA, 100 bp, Artificial Sequence; identical to SEQ ID NO: 360
  Synthetic polynucleotide
  misc_feature (1)..(100): 100 bp downstream of junction

SEQ ID NO: 442 - DNA, 100 bp, Artificial Sequence; identical to SEQ ID NO: 359
  Synthetic polynucleotide
  misc_feature (1)..(100): 100 bp downstream of junction

SEQ ID NO: 443 - DNA, 100 bp, Artificial Sequence
  Synthetic polynucleotide
  misc_feature (1)..(100): 100 bp downstream of junction
ccttgattatggccgcggcgagctgcacccgctctctgacgtcgcactgctgatcctcagccgcaaaaaactgcctgacgaccaggcgcaaaaggtcggc

SEQ ID NO: 444 - DNA, 100 bp, Artificial Sequence
  misc_feature (1)..(100): 100 bp downstream of junction
  Synthetic polynucleotide
ctgctgatcctcagccgcaaaaaactgcctgacgaccaggcgcaaaaggtcggcgaactgctgacgctactgtgggacgtcaagctggaggtgggccaca

SEQ ID NO: 445 - DNA, 100 bp, Artificial Sequence; identical to SEQ ID NO: 362
  misc_feature (1)..(100): 100 bp downstream of junction
  Synthetic polynucleotide

SEQ ID NO: 446 - DNA, 100 bp, Artificial Sequence
  Synthetic polynucleotide
  misc_feature (1)..(100): 100 bp downstream of junction
gcgttaaaagatatttttgtgcgtaccgaacctcgcagacggcattatggcgttgcattgtttatcgggcttatttctggggttgtttcagcatttgtta

SEQ ID NO: 447 - DNA, 200 bp, Artificial Sequence; identical to SEQ ID NO: 396
  5 prime upstream region of nifL Prm1.2

SEQ ID NO: 448 - DNA, 200 bp, Artificial Sequence; identical to SEQ ID NO: 397
  Prm1.2 mifA

SEQ ID NO: 449 - DNA, 200 bp, Artificial Sequence; identical to SEQ ID NO: 395
  1647 bp deletion of glnE N-terminus after the start codon

SEQ ID NO: 450 - DNA, 200 bp, Artificial Sequence
  5 prime region of NtrC upstream of D54A (GAT to GCT) mutation
acgcgcgctcaccggagccggcttgagctgcacaacgttcgaaagcggcaatgaggtgctagatgccctcaccaccaaaaccccggatgtactgctgtcagctatccgtatgccgggaatggatggtctggcgctgctcaaacagattaagcagcgtcatccaatgcttccggtcatcataatgaccgcacattccgatc

SEQ ID NO: 451 - DNA, 200 bp, Artificial Sequence
  NtrC sequence downstream of the D54A (GAT to GCT) mutation
cgcgctcaccggagccggcttgagctgcacaacgttcgaaagcggcaatgaggtgctagatgccctcaccaccaaaaccccggatgtactgctgtcagctatccgtatgccgggaatggatggtctggcgctgctcaaacagattaagcagcgtcatccaatgcttccggtcatcataatgaccgcacattccgatctgg

SEQ ID NO: 452 - DNA, 200 bp, Artificial Sequence; identical to SEQ ID NO: 394
  5 prime upstream region of nifL PinfC

SEQ ID NO: 453 - DNA, 200 bp, Artificial Sequence; identical to SEQ ID NO: 393
  PinfC nifA

SEQ ID NO: 454 - DNA, 200 bp, Artificial Sequence
  5 prime downstream region of glnD-Utase deactivation mutation
agctcattgcggcgcgcaccgaatttatcgaccagctgctgcagcggttgtggatcgcctacggttttgaatccgtctgcgatctggcgctggtggccgtccttgattatggccgcggcgagctgcacccgctctctgacgtcgcactgctgatcctcagccgcaaaaaactgcctgacgaccaggcgcaaaaggtcggc

SEQ ID NO: 455 - DNA, 200 bp, Artificial Sequence
  3 prime downstream region of glnD-Utase deactivation mutation
gttgtggatcgcctacggttttgaatccgtctgcgatctggcgctggtggccgtccttgattatggccgcggcgagctgcacccgctctctgacgtcgcactgctgatcctcagccgcaaaaaactgcctgacgaccaggcgcaaaaggtcggcgaactgctgacgctactgtgggacgtcaagctggaggtgggccaca

SEQ ID NO: 456 - DNA, 200 bp, Artificial Sequence
  5 prime downstream of an extra copy of Prm1.2 nifA gene inserted in a non-coding site of Klebsiella genome between two hypothetical coding sequences
acggcagggttttgtgtttttgaaaacaaatgcctgaaatcggctataaagtgtgatctgcatcaaaatgccatgcgccaaacttaaggaatattaaggagcccgctgaccgaccagaacttccaccttggactcggctatacccttggcgtgacggcgcgcgataactgggactacatccccattccggtgatcttacc

SEQ ID NO: 457 - DNA, 200 bp, Artificial Sequence
  3 prime downstream of an extra copy of Prm1.2 nifA gene inserted in a non-coding site of Klebsiella genome between two hypothetical coding sequences
ggaacgcgacaatgttgtgccgcagggatgcgggataatgctttatttttcagccagataaaaaattcgtcactggtacgtcgtttgcagcaggaaggtagcgttaaaagatatttttgtgcgtaccgaacctcgcagacggcattatggcgttgcattgtttatcgggcttatttctggggttgtttcagcatttgtta

SEQ ID NO: 458 - DNA, 2061 bp, Artificial Sequence
  delta nifL-Prm1.2
gcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtacgcggcgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctactatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttatcggatccagatcatggatatcaccctgccgcgtctgtag

SEQ ID NO: 459 - DNA, 1056 bp, Artificial Sequence
  delta nifL-Prm1.2 with 500 bp flank
tgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagc

SEQ ID NO: 460 - DNA, 1191 bp, Artificial Sequence; identical to SEQ ID NO: 191
  glnE KO2

SEQ ID NO: 461 - DNA, 576 bp, Artificial Sequence
  glnE KO2 with 500 bp flank
tattaacctctcgcgggtggcggccgagctgcgcagcgccgtgcagcatctggcggttgaagatgccgccgaccagttgccgaagctgtcccgcgacatcgacagcgtccagctgctggcgggcgcctatggcgacgccgtcgcgccgtggctggagaactggcaggagcttcaccgtgcaatagcacatgacgatcgcagcgtctttgaatatttccgtcgccaggcgctggctgccgagccgttctggctgcatagtggaaaacgataatttcaggccagggagcccttatggcgctgaagcacctgatcacgctctgcgcggcgtcgccgatggtcgccagccagctggcgcgccacccgctgctgctggatgagctgctggatcccaacaccctctatcagccgacggcgaccgatgcctatcgcgacgagctgcgccagtacctgctgcgcgtgccggaagaggatgaagagcagcagctggaggcgttgcgccagtttaagcaggcgcagcagctgcatatcgcggcggcggatatcgctggtaccctgccggtgatgaaggtcagcgat

SEQ ID NO: 462 - DNA, 1410 bp, Artificial Sequence
  NtrC D54A
atgcaacgagggatagcctggatcgttgatgacgatagctccatccgctgggtgcttgaacgcgcgctcaccggagccggcttgagctgcacaacgttcgaaagcggcaatgaggtgctagatgccctcaccaccaaaaccccggatgtactgctgtcagctatccgtatgccgggaatggatggtctggcgctgctcaaacagattaagcagcgtcatccaatgcttccggtcatcataatgaccgcacattccgatctggacgctgcggtcagcgcttatcagcaaggcgcgtttgattatctgcccaaaccttttgatattgatgaagccgtcgccctggtcgaccgggcgataagccactatcaggagcagcaacagccgcgaaatgcgccaataagcagcccaactgccgacatcatcggcgaagcgccggcaatgcaggatgtctttcgcattattggccgtttgtcgcgatcatccatcagcgtgctgattaatggcgaatccggtaccggtaaagagctcgtcgctcacgccctgcatcgtcatagcccacgttcaaaagcgccgtttatcgcactgaatatggcggcaatacccaaagacctgattgagtccgagctgttcgggcatgaaaaaggggcctttaccggcgccaataccgtccgccagggacgcttcgaacaggctgacggcggcacgctattcctggatgaaattggcgatatgccgcttgatgtccagactcgtctgctgcgcgtgctggcggatggccagttttatcgcgtgggcggttacgcgccggtgaaggtcgatgtgcggatcatcgccgccacccaccagaacctggaacagcgcgtgcaggaggggaaattccgtgaagatttgttccaccgcctgaacgtgatccgggtgcatttaccgccgctgcgcgagcgccgggaagatattccacgcctggcccgccattttctgcagatagccgcccgcgagctcggtgttgaagccaaacagctgcatccggaaacggagacagcgctgacacgcctggcgtggcctggcaacgtccgtcagctggaaaacacctgtcgctggctcaccgtcatggccgccggccaggaggtactgacgcaggatctgccgagcgaactgtttgagactacggttccggacagcccgacgcagatgcagcccgacagctgggcgacgctgctgggtcagtgggccgatcgggcgttgcgatccggtcatcaaaacctgctctcagaagcgcaacccgaaatggagcgcacgctgctgacgaccgccctgcgccatacccaggggcacaagcaggaggctgcgcgtctgctgggatggggtcgtaataccctgacgcgtaagctaaaagagctgggaatggagtag

SEQ ID NO: 463 - DNA, 1244 bp, Artificial Sequence
  NtrC D54A with flanking sequences
gaccggctgagaaatctggtcgatcgcctgcttgggccacagcatccgggcatgcacgttactgaaagtatccataaagtcgccgagcgggtagtgaaactggtctccatggagttaccggacaacgtgaagttaatccgtgattacgaccccagcctaccagagctaccccacgacccggatcaaattgaacaggtgttgctgaacatcgtccgtaatgcgctgcaggcgctggggccggaagggggcgaaattgttctccgcacccgcaccgctttccagctgacgctgcacggggtgcgttatcgcctcgccgcacgtattgacgttgaagataatggcccgggtattccgccccatctccaggatacgctgttttatccgatggtcagcggccgcgaaggcggtaccggcctgggcttatctatcgcccgcagccttatcgatcagcactccggcaaaattgaattcaccagctggccgggtcataccgaattttcggtatacctgcctattcggaagtagaggtgtttatgcaacgagggatagcctggatcgttgatgacgatagctccatccgctgggtgcttgaacgcgcgctcaccggagccggcttgagctgcacaacgttcgaaagcggcaatgaggtgctagatgccctcaccaccaaaaccccggatgtactgctgtcagctatccgtatgccgggaatggatggtctggcgctgctcaaacagattaagcagcgtcatccaatgcttccggtcatcataatgaccgcacattccgatctggacgctgcggtcagcgcttatcagcaaggcgcgtttgattatctgcccaaaccttttgatattgatgaagccgtcgccctggtcgaccgggcgataagccactatcaggagcagcaacagccgcgaaatgcgccaataagcagcccaactgccgacatcatcggcgaagcgccggcaatgcaggatgtctttcgcattattggccgtttgtcgcgatcatccatcagcgtgctgattaatggcgaatccggtaccggtaaagagctcgtcgctcacgccctgcatcgtcatagcccacgttcaaaagcgccgtttatcgcactgaatatggcggcaatacccaaagacctgattgagtccgagctgttcgggcatgaaaaaggggcctttaccggcgccaataccgtccgccagggacgcttcgaacaggctgacggcggcacgctattc

SEQ ID NO: 464 - DNA, 824 bp, Artificial Sequence
  delta nifL PinfC
agcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagc

SEQ ID NO: 465 - DNA, 1156 bp, Artificial Sequence
  delta nifL PinfC with flanking sequences
tgtcggaatggtgttgaaaaaaggaatgacgacagaggtattgcgaaggctgtgccaggttgccctgcaccgcgacggcccatccctgccccatcaggatcgcttcgcatcacgatgccgcgcgccaaaggcgcacccggcggggcgaaaggtaaaaatccgtgaattttccccctgtcggatcaatgtttcgcgtggtcgttccgataagggcgcacactttgcatggttatccgggttcggcttaccccgccgcgttttgcgcacggtgtcggacaatttgtcataactgcgacacaggagtttgcgatgaccctgaatatgatgctcgaagcgtcaggtaccggtcatgattcaccgtgcgattctcggttccctggagcgcttcattggcatcctgaccgaagagttcgctggcttcttcccaacctggattgcaccagtgcaggtagtggtcatgaatattaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaagtgaagtgattgagaagctgcaacaagagattcgcagccgcagtcttcaacaactggaggaataaggtattaaaggcggaaaacgagttcaaacggcacgtccgaatcgtatcaatggcgagattcgcgccctggaagttcgcgccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagc

SEQ ID NO: 466 - DNA, 2664 bp, Artificial Sequence
  glnD UTase Deactivation
atgagcaactcattacctgacacagcctcccctcttctgcccgtcccgccggaacatccggtgagctggccgcagggcgatctgaactgtgctgcaattaaggcgcacatcgataccttccagcactggctgggcgaggcgtttgactccggcatcgccgcggagcagctcattgcggcgcgcaccgaatttatcgaccagctgctgcagcggttgtggatcgcctacggttttgaatccgtctgcgatctggcgctggtggccgtccttgattatggccgcggcgagctgcacccgctctctgacgtcgcactgctgatcctcagccgcaaaaaactgcctgacgaccaggcgcaaaaggtcggcgaactgctgacgctactgtgggacgtcaagctggaggtgggccacagcgtgcgcaccctcgaagagtgtctgctcgaaggactttcggatctcaccgtcgccactaacttgattgaatcgcgcctgctgatcggcgacgtcgcgctgttccttgaactgcaaaaacatatttttagcgacggcttctggccatcggaaaagttcttcgccgccaaggtggaagagcagaacgtccgtcatcaacgctatcacggcaccagctataacctggagccggacgtgaaaagcagccccggcggcctgcgggatatccatacgctacagtgggtggctcgccgtcattttggcgccacctcgatggatgagatggtcggcttcggctttctgaccgaagccgagcgcaatgagctcaacgagtgtctgcatcagctgtggcgcatccgtttcgcgctgcatctcgagctcactcgctatgacaaccgtctgcttttcgaccgccagctcagcgtcgcccgccggctcggctatgaaggcgacggcaaccagccgattgagcatatgatgaaggacttcttccgcgtcacccgccgggtgagcgagctgaaccagatgctgcttcagctgtttgaagaggctattctcgccctgaccgaggatgaaaaaccgcgcccgatagacgatgacttccagctgcgcggcacccttatcgatctgcgtgacgacacgctgtttattcgcgaaccgcaggccattctgcgcatgttttatatgatggtgcgcaacagcactatcaccggcatctactccacgacgttgcgccatctgcgccatgcccggcgccatctgacccagccgctgtgctatatcccggaggcgcgcacgctctttctcagcatgctgcgccatcagggggcggtcagccgcggactgctgccgatgcatcgccatagcgtgctgtgggcctatatgccgcagtggtcacatatcgtcggccagatgcagttcgatctgtttcacgcctacaccgtcgatgaacacaccatccgcgtgatgctgaagctggagagctttgccaaagaagaaacccgcagccgccacccgctgtgcgtggagctatggccgcgcttaacgcacccggagctgattttaatcgccgccctgttccacgacattgcgaaagggcgtggcggcgaccactcgatcctcggcgcgcaggatgtgctgaagtttgccgagctgcacggactgaactctcgcgaaacgcagttggtcgcctggctggtgcgtcaccatctgctgatgtcggtcaccgcccagcggcgcgacattcaggatccggaggtgattaagcagttcgccgaggaagtgcaaacggaaaatcgcctgcgctatctggtgtgcctgaccgtcgccgacatctgcgccaccaacgaaacgctgtggaacagctggaagcagagtctgctgcgcgaactctatttcgccaccgagaaacagctgcgtcggggcatgcaaagcaccccggatatgcgcgaacgggtgcgtcatcatcagctgcaggcgctggccctgctgcggatggacaatattaatgaagaggcgctgcatcagatctggaaccgctgccgcgccaactatttcgtgcggcatacgccgacgcagctcgcctggcacgcccgcaacctgctgcgtcacgatctgaataagccgatgattctgctgagttcgcaggccacccgcggcggtacggagatttttatctggagcccggatcgcccttatctgtttgccgcggtgtgcggcgaactggaccgccgcaacctcagcgtccacgacgcgcagatcttcaccacccgcgacggcatggcgatggatacctttattgtcctcgaacccgacggcagcccgctttccgctgaccgccacgacgcgattcgccacggtcttgaacagacgataactcagcgcagctgggaacccccggccccgcgtcgtcaggcggcaaaactgcgtcacttctctgtgccgacagaggtgaatttcctgccgacccataccgatcgaaaatcgtttctcgagctgattgcgctcgatcagccagggctgctcgcccgcgtcggccaggtgttcgccgacctcggtatttcgcttcacggggcgcgaattacgacaattggtgagcgagtagaagatttatttataatcgccaccgccgaccggcgtggccttaataatgagctacaacaagaagtgcaacaacggttgacagaggccctcaatccaaacgataaagggtga

SEQ ID NO: 467 - DNA, 946 bp, Artificial Sequence
  glnD UTase Deactivation with flanking sequences
gaaaactaaagaccggagcttgtctgcgcagtacgagcatactattgtggtgacagacaacggctgcgaaattctgacgctacgcaaggatgacaccatcccggcgataatctcgcacgatgaatgatgaaaagccggcgcccgccggcttttttattagatagttttttcttatggtgacgcgatgagcaactcattacctgacacagcctcccctcttctgcccgtcccgccggaacatccggtgagctggccgcagggcgatctgaactgtgctgcaattaaggcgcacatcgataccttccagcactggctgggcgaggcgtttgactccggcatcgccgcggagcagctcattgcggcgcgcaccgaatttatcgaccagctgctgcagcggttgtggatcgcctacggttttgaatccgtctgcgatctggcgctggtggccgtccttgattatggccgcggcgagctgcacccgctctctgacgtcgcactgctgatcctcagccgcaaaaaactgcctgacgaccaggcgcaaaaggtcggcgaactgctgacgctactgtgggacgtcaagctggaggtgggccacagcgtgcgcaccctcgaagagtgtctgctcgaaggactttcggatctcaccgtcgccactaacttgattgaatcgcgcctgctgatcggcgacgtcgcgctgttccttgaactgcaaaaacatatttttagcgacggcttctggccatcggaaaagttcttcgccgccaaggtggaagagcagaacgtccgtcatcaacgctatcacggcaccagctataacctggagccggacgtgaaaagcagccccggcggcctgcgggatatccatacgctacagtgggtggctcgccgtcattttggcgccacctcgatggatgagatggtcggcttcggctttctgaccgaagcc

SEQ ID NO: 468 - DNA, 2061 bp, Artificial Sequence; identical to SEQ ID NO: 458
  NC-nifA copy Prm1.2

SEQ ID NO: 469 - DNA, 6456 bp, Artificial Sequence
  NC-nifA copy Prm1.2 with flanking sequences
atcaaaatgcaagctcggctgcgttctggaggccgactttaagcttgtccgcaatccggcgtttcaccgccgttactttgctttactcaatctcggttttgaatattgggagcctaccggcggggcgatttcgtctaatgagcgcaggcttatcacaggttacgccaaataccttgctgcatatggcgggagtgaatcggcgttacttgatgccgccgggcaatatctcgaccgaatagccgagaagcgatccggctatatcagtatttgcaaatctttcgatgcttaccgggcgtgggtcatcgtagaagcaggccactatgacgccatacagctgccggacggtacgctgaaaaaacaccctcgcagcatttctttcgccagcatggacgaatgcgaatttcaggaactgtacaaagcatcgctcgatgttctctggcggtggatcctctctcattcgttcaacagcctgcaggaagctgagaacgccgcaaaccagcttttaagttttgcggggtgatgccgatgaaacactcatggtttcaccatcacgaatgcacaacacagcaggccgacgaactgatggcgagatatcgccagcggggcgtaaaggtcgaacgaagcttaaaccctgactttatgacatggaccgttagcgcgcagctggtggaggacaaaactccgccgcggccagactctcgctggcgcaacaggatgtgggagtgagtatggcgaaccttcgcaaagcggcccgaggccgcgaatgcacagtgcggatccccgggtactgcaacggcaacccggaaaccagtgtactggcgcattaccgtctggctggcacctgcggaactggatgcaagccggacgatacccaggcggctattgcctgtaatgcatgccacgatctcatcgatggcagaaagaaaaccacagattacacccgcgacgaactgcgcctgatgcatgcggaaggtgtgctcagaacattggctatatggaaaaaagagggggtactgaaagcatgaaactcgaagcgtccttaaaacatttcagccctcagggtatgcacatcagcgatgacgtgaaaagcacaacaccaaatcgcctgaccggaacagatgttatggcggccatcggtaccaccagcagtcgtgcacgattcggcctggctgcatttttcggtaaagctggcatcagcaagacagatgagcagttggccgtccaggcgctagcgcggtatgcgattgaaaccgcaccgaagaacgtacgcaaaacagctggtaaagagctggggcgctgctgcctgattttggcacagtttgcctttgcggagtattcccggtccgcggaaacaacgggagtctgcagggtatgcagtggcaccggacagattgaaaccactaccacagaacgcaaagtttctaatccgtggggcaaagcaccatattgggcaaacaggtcccgtgctgttcgtccgtccgactgggataagtggactgaagtaacagctagcgtaagcgctaaatgtgaagcctgtgacggtaaggggaaaattaacgcgcgctgccgctgtggtggttctggccgggttctggaccgcaaagcgacaaaagagcagggagcaccgatatataaaatctgtgagcgctgttcggggaatggcttttcaacgatgccgtctactgctgcttataaagcgattctgacgcttatcccagacctgcacatcagaacatggacacgcaactggaaacctttctgcgatgcgatggtggacctatgctggagggaagaaaagagggcagataaagagtttcaacgagcaacagctgattgagtaaatggtcgcattattttgcattttaagcgcacgatgcttgattttgtccgaagttgtcgtgtatattttaaatcgtggaataaaacgcctgaacaaaaacattcatataaaccctgctacggcagggttttgtgtttttgaaaacaaatgcctgaaatcggctataaagtgtgatctgcatcaaaatgccatgcgccaaacttaaggaatattaaggagcccgctgaccgaccagaacttccaccttggactcggctatacccttggcgtgacggcgcgcgataactgggactacatccccattccggtgatcttaccattggcgtcaataggttacggtccggcgactttccagatgacctatattcccggcacctacaataacggtaacgtttacttcgcctgggctcgtatacagttttaattcgctaagtcttagcaataaatgagataagcggtgtgtcttgtggaaaaacaaggactaaagcgttacccactaaaaaagatagcgacttttatcactttttagcaaagttgcactggacaaaaggtaccacaattggtgtactgatactcgacacagcattagtgtcgatttttcatataaaggtaattttggccattgagctggcttcccgaccgcagggcggcacctgcctgaccctgcgtttcccgctgtttaacaccctgaccggaggtgaagcatgatccctgaatccgacccggacaccaccgtcagacgcttcgacctctctcagcagttcaccgccatgcagcggataagcgtggtgctgagccgggccaccgaggccagcaaaacgctgcaggaggtgctcagcgtattacacaacgatgcctttatgcagcacgggatgatctgcctgtacgacagcgagcaggagatcctcagtatcgaagcgctgcagcaaaccggccagcagcccctccccggcagcacgcagatccgctatcgccccggcgagggactggtggggaccgtgctggcccaggggcagtcgctggtgctgccccgggtcgccgacgatcagcgttttctcgaccgcctgagcctctacgattacgatctgccgtttatcgccgtaccgttgatggggcccaacgcccggccaataggggtgctggcggcccagccgatggcgcgccaggaagagcggctgccggcctgcacccgttttctcgaaaccgtcgccaacctcgtcgcccagaccatccggctgatgatccttccggcctcacccgccctgtcgagccgccagccgccgaaggtggaacggccgccggcctgctcgtcgtcgcgcggcgtgggccttgacaatatggtcggcaagagcccggcgatgcgccagatcgtggaggtgatccgtcaggtttcgcgctgggacaccaccgtgctggtacgcggcgaaagcggcaccgggaaagagctgatcgccaacgccatccatcaccattcgccacgggctggcgccgccttcgtcaaatttaactgcgcggcgctgccggacaccctgctggaaagcgaactgttcggccatgagaaaggcgcctttaccggggcggtgcgtcagcgtaaaggacgttttgagctggcggatggcggcaccctgttcctcgatgagattggtgaaagcagcgcctcgttccaggccaagctgctgcgtatcctccaggagggggagatggagcgggtcggcggcgatgagaccctgcgggtgaatgtccgcatcatcgccgccaccaaccgtcacctggaggaggaggtccggctgggccatttccgcgaggatctctactatcgtctgaacgtgatgcccatcgccctgcccccgctgcgcgagcgtcaggaggacatcgccgagctggcgcacttcctggtgcgcaaaatcggccagcatcaggggcgcacgctgcggatcagcgagggcgcgatccgcctgctgatggagtacagctggccgggtaacgttcgcgaactggagaactgcctcgaacgatcggcggtgatgtcggagagtggcctgatcgatcgcgacgtgatcctcttcactcaccaggatcgtcccgccaaagccctgcctgccagcgggccagcggaagacagctggctggacaacagcctggacgaacgtcagcgactgatcgccgcgctggaaaaagccggctgggtgcaggccaaggcggcacggctgctggggatgacgccgcgccaggtcgcttatcggatccagatcatggatatcaccctgccgcgtctgtaggccgcggtgtcaggttcaggacattgtcgtcagtgcggcaggaacgcgacaatgttgtgccgcagggatgcgggataatgctttatttttcagccagataaaaaattcgtcactggtacgtcgtttgcagcaggaaggtagcgttaaaagatatttttgtgcgtaccgaacctcgcagacggcattatggcgttgcattgtttatcgggcttatttctggggttgtttcagcatttgttaaatggggtgctgaagtaccattaccaccgcgtagccctgtcgacatgtttaccagtgcctgtggaccagagtcattaattcgagctgccgggcaaattgattgctccagaaacttccttaaccctccttatatttttctgcgtgattggttagggttagccgatccaaatgcggctgtctttaccttcgccggacatgtgtttaactgggtaggcgtaacacatatcatattctcgatcgtgttcgcggttgggtattgtgtagttgctgaggtgtttccaaaaattaagctgtggcagggtttgcttgcaggtgcgctcgcacaactgtttgtccatatgatttcgttcccgcttatgggcctaaccccaccgttgttcgaacttccatggtatgaaaacgtttctgaaatatttggtcacctggtgtggttctggtccattgagataattcgccgggatctcagaaacagaattacgcatgaacctgatgctgaggtttctctgaattcagcattcagataatccaagctgcaaagccaggaacccgcataaaatgcgggttttttatgcctgcgattagtagctgttcgacagcgctgttcgctgcgatggcagccgtaagataggcgtctttcacaggcattgtattgacgccagctatgtttgcagcataacgtattgatgtggtgaatccccctgtgcggaggggcgaccagtcagttacagaaacctgtaaatgcagcgcgggccatgccgactggggcatgctcaccggaggcacccggcaccacactgtcactaagcatattgaatatttcatagtgggtttacttttgcggtagcccttctacgtttatagaacgtaacggcaaaagtgaatgcttcctggtaaatcggtagctcggactattaggagtgctttcgtttcgttactacctagaatgcctactttctgcccgcttctctgagcgggctttttttattcctaatcagttcacgtaaaacatcaaaacaataattatgcattcatctgctggcatgccttttaccttcaactgagagacactcctggcgatgagaaggagagttgaagcatgctttatgtctaaatctctggccatagcaacgtatggcattgaaacaatgttatcgagatgttaggttttgtatgtggtgaatccccctagcggaggggcgtaacagttagaagtgaatcctcagcgcgagtcacggtgactgaccaacgacttaccgggaagcacccggcaccacacatactgcataaccccctaaaggccttccattccggtaggccttttctcttctgggcgccatgacgtaaaagttcagcccgtagacctataactgtctgtgggttcgtcaggccacattgcctgatgggctcacttttgtaagctatacgggcgctgcagtggatgctttaccagagattatgatgatgtaaagcctaagcgactgggagtttgtcttgagtgaaaatcttactacagtgagggcacatcagcgcagagcctttctggactcgggtgtaactatgttctgattggttggcgcagccagggcaggtacatttgatgaggtagttgcgattgttttttgagtttttgcgttgttgcatatgatatttcctgatgaatggtccgcaaccatacactatccccaggcacatagctcgcgttgaattccccaaccacctcttcaaggtggttttttctttcaggtacccggaatcaccattgatgagtattccacctgccggtcctgatccctttcaaacacacagcaccccgttaacccggaggtgaacctatggcaaagcatatgcaagacaaagagagcatggccggaatcacctggctagctctgctgatcattgctggttggggcggccttgtccgattcctgatggatgtgaagcagggcaaagcaaaatggagctggataaatgcttttgcgcagattgtggtttcggcttttaccggggttattggtgggctcatcagcattgaaggtggcctgagtatttacatgatactggccactgccggtatcagtggtgctatgggttccgtag

---

What is claimed is:

1. A composition to reduce bacterial cell viability loss during liquid or dry storage, comprising:

(i) isolated *Klebsiella variicola*, and (ii) one or more isolated biofilms produced by *Kosakonia sacchari*, wherein the one or more isolated biofilms comprise an extracellular polymeric substance, and are free of viable *Kosakonia sacchari* cells, and wherein the one or more isolated *Klebsiella variicola* exhibit less viability loss in liquid or dry storage for at least 30 days compared to a control composition comprising the isolated *Klebsiella variicola* and lacking the one or more isolated biofilms stored under the same conditions.

2. The composition of claim 1, wherein the isolated *Klebsiella variicola* is a *Klebsiella variicola* 137-1036 strain.

3. The composition of claim 1, wherein the isolated *Klebsiella variicola* exhibit less viability loss when stored in liquid culture for at least 90 days compared to a control composition comprising the isolated *Klebsiella variicola* and lacking the one or more isolated biofilms stored under the same conditions.

4. The composition of claim 1, wherein the isolated *Klebsiella variicola* bacteria are non-intergeneric remodeled bacteria.

5. The composition of claim 4, wherein the non-intergeneric remodeled bacteria are capable of fixing atmospheric nitrogen in the presence of exogenous nitrogen.

6. The composition of claim 1, wherein the isolated *Klebsiella variicola* comprises at least one genetic variation introduced into a member selected from the group consisting of: a polynucleotide encoding glutamine synthetase, a polynucleotide encoding glutaminase, a gene associated with biosynthesis of a nitrogenase enzyme, and combinations thereof.

7. The composition of claim 1, wherein the isolated *Klebsiella variicola* comprises bacteria selected from: a bacterium deposited as NCMA 201712002, a bacterium deposited as NCMA 201708001, a bacterium deposited as NCMA 201712001, and combinations thereof.

8. The composition of claim 1, wherein the isolated *Klebsiella variicola* comprises bacteria comprising a nucleic acid sequence that shares at least about 90% sequence identity to a nucleic acid sequence selected from SEQ ID NOs: 96-110, 191-210, 325-333, 359, 393-401, 425-437, 296 303, and 458-469.

9. A method for reducing bacterial cell viability loss in a bacterial composition, the method comprising, combining:

(i) isolated *Klebsiella variicola*, and (ii) one or more isolated biofilms produced by *Kosakonia sacchari*, wherein the one or more isolated biofilms comprise an extracellular polymeric substance, and are free of viable *Kosakonia sacchari* cells, and wherein the *Klebsiella variicola* exhibit less viability loss for at least 30 days compared to a control composition comprising the *Klebsiella variicola* and lacking the one or more isolated biofilms stored under the same conditions.

10. The method of claim 9, wherein the isolated *Klebsiella variicola* is a *Klebsiella variicola* 137-1036 strain.

11. The method of claim 9, wherein the isolated *Klebsiella variicola* is capable of fixing atmospheric nitrogen.

12. The method of claim 9, wherein the isolated *Klebsiella variicola* exhibit less viability loss when stored in liquid culture for at least 90 days.

13. The method of claim 9, wherein the isolated *Klebsiella variicola* are non-intergeneric remodeled bacteria.

14. The method of claim 9, wherein the isolated *Klebsiella variicola* comprises at least one genetic variation introduced into a member selected from the group consisting of: a polynucleotide encoding glutamine synthetase, a polynucleotide encoding glutaminase, a gene associated with biosynthesis of a nitrogenase enzyme, and combinations thereof.

15. The method of claim 9, wherein the isolated *Klebsiella variicola* comprise bacteria selected from: a bacterium deposited as NCMA 201712002, a bacterium deposited as NCMA 201708001, a bacterium deposited as NCMA 201712001, and combinations thereof.

16. The method of claim 9, wherein the isolated bacteria *Klebsiella variicola* comprise bacteria comprising a nucleic acid sequence that shares at least about 90%, sequence identity with a nucleic acid sequence selected from SEQ ID NOs: 96-110, 191-210, 325-333, 359, 393-401, 425-437, and 458-469.

17. The composition of claim 1, wherein the isolated *Klebsiella variicola* exhibit less viability loss when stored at 37° C., compared to a control composition comprising the isolated *Klebsiella variicola* and lacking the one or more isolated biofilms stored under the same conditions.

18. The method of claim 9, wherein the isolated *Klebsiella variicola* exhibit less viability loss when stored at 37° C., compared to a control composition comprising the isolated *Klebsiella variicola* and lacking the one or more isolated biofilms stored under the same conditions.

19. The composition of claim 1, wherein the isolated *Klebsiella variicola* comprises at least one genetic variation introduced into a member selected from the group consisting of: nifA, niL, ntrB, ntrC, glnA, glnB, glnK, drat, amtB, glnD, glnE, nifJ, nifH, nifD, nifK, nifY, nifE, nifN, nifU, nifs, nifV, nifW, nifZ, nifM, nifF, nifB, nifQ, bcsii, bcsiii, yjbE, fhaB, pehA, otsB, treZ, glsA2, and combinations thereof.

20. The method of claim 9, wherein the isolated *Klebsiella variicola* comprises at least one genetic variation introduced into a member selected from the group consisting of: nifA, niL, ntrB, ntrC, glnA, glnB, glnK, drat, amtB, glnD, glnE, nifJ, nifH, nifD, nifK, nifY, nijE, nifN, nifU, nifs, nifV, nifW, nifZ, nifM, nifF, nijB, nifQ, bcsii, bcsiii, yjbE, fhaB, pehA, otsB, treZ, gsA2, and combinations thereof.

* * * * *